(12) United States Patent
Seidel, III et al.

(10) Patent No.: US 11,702,461 B2
(45) Date of Patent: Jul. 18, 2023

(54) T-CELL MODULATORY MULTIMERIC POLYPEPTIDES COMPRISING REDUCED-AFFINITY IMMUNOMODULATORY POLYPEPTIDES

(71) Applicant: Cue Biopharma, Inc., Cambridge, MA (US)

(72) Inventors: Ronald D. Seidel, III, Cambridge, MA (US); Rodolfo J. Chaparro, Cambridge, MA (US)

(73) Assignee: Cue Biopharma, Inc., Boston, MA (US)

( * ) Notice: Subject to any disclaimer, the term of this patent is extended or adjusted under 35 U.S.C. 154(b) by 0 days.

(21) Appl. No.: 16/909,323

(22) Filed: Jun. 23, 2020

(65) Prior Publication Data
US 2020/0317747 A1    Oct. 8, 2020

Related U.S. Application Data

(63) Continuation of application No. PCT/US2019/012688, filed on Jan. 8, 2019.

(60) Provisional application No. 62/782,109, filed on Dec. 19, 2018, provisional application No. 62/782,214, filed on Dec. 19, 2018, provisional application No. 62/713,408, filed on Aug. 1, 2018, provisional application No. 62/615,253, filed on Jan. 9, 2018, provisional application No. 62/615,225, filed on Jan. 9, 2018.

(51) Int. Cl.
| C07K 14/705 | (2006.01) |
| C07K 16/08 | (2006.01) |
| C12N 15/86 | (2006.01) |
| C07K 14/74 | (2006.01) |

(52) U.S. Cl.
CPC ...... *C07K 14/70539* (2013.01); *C07K 16/082* (2013.01); *C12N 15/86* (2013.01); *C07K 2317/34* (2013.01); *C07K 2317/92* (2013.01); *C12N 2730/10122* (2013.01)

(58) Field of Classification Search
None
See application file for complete search history.

(56) References Cited

U.S. PATENT DOCUMENTS

| 5,635,363 | A | 6/1997 | Altman et al. |
| 6,197,302 | B1 | 3/2001 | Hirsch et al. |
| 6,211,342 | B1 | 4/2001 | Hirsch et al. |
| 6,268,411 | B1 | 7/2001 | Schneck et al. |
| 6,696,304 | B1 | 2/2004 | Parker |
| 7,098,306 | B2 | 8/2006 | Economou et al. |
| 7,186,804 | B2 | 3/2007 | Gillies et al. |
| 7,432,351 | B1 | 10/2008 | Chen |
| 7,670,595 | B2 | 3/2010 | Gillies et al. |
| 8,992,937 | B2 | 3/2015 | Hansen et al. |
| 9,284,349 | B2 | 3/2016 | Tsunoda et al. |
| 9,359,424 | B2 | 6/2016 | Maoult et al. |
| 9,494,588 | B2 | 11/2016 | Springer et al. |
| 10,272,042 | B2 | 4/2019 | Daftarian et al. |
| 10,501,521 | B2 | 12/2019 | Georges et al. |
| 10,927,158 | B2 | 2/2021 | Seidel et al. |
| 10,927,161 | B2 | 2/2021 | Seidel et al. |
| 11,117,945 | B2 | 9/2021 | Seidel et al. |
| 11,377,478 | B2 | 7/2022 | Seidel et al. |
| 11,380,821 | B2 | 7/2022 | Jia et al. |
| 2002/0006664 | A1 | 1/2002 | Sabatini |
| 2002/0031520 | A1 | 3/2002 | Economou et al. |
| 2004/0038349 | A1 | 2/2004 | Hilbert et al. |
| 2004/0132977 | A1 | 7/2004 | Gantier et al. |
| 2004/0161817 | A1 | 8/2004 | Benton et al. |
| 2004/0209363 | A1 | 10/2004 | Watts et al. |
| 2005/0003431 | A1 | 1/2005 | Wucherpfennig et al. |
| 2005/0009012 | A1 | 1/2005 | Holzberg et al. |
| 2005/0100926 | A1 | 5/2005 | Hedley et al. |
| 2005/0142142 | A1 | 6/2005 | Burrows et al. |
| 2006/0034865 | A1 | 2/2006 | Hildebrand et al. |
| 2006/0269515 | A1 | 11/2006 | Deniz-Mize et al. |
| 2007/0036752 | A1 | 2/2007 | Gillies et al. |
| 2007/0148162 | A1 | 6/2007 | Bhardwaj et al. |
| 2007/0286843 | A1 | 12/2007 | Pfizenmaier et al. |
| 2008/0199485 | A1 | 8/2008 | Kundig et al. |
| 2008/0219947 | A1 | 9/2008 | Linette et al. |
| 2008/0269070 | A1 | 10/2008 | Ramseier et al. |
| 2010/0159594 | A1 | 6/2010 | Hansen et al. |
| 2011/0002956 | A1 | 1/2011 | Weiner et al. |

(Continued)

FOREIGN PATENT DOCUMENTS

| CN | 1791675 | 6/2006 |
| CN | 101384621 | 3/2009 |

(Continued)

OTHER PUBLICATIONS

Ackerman, et al.; "Highly Avid Magnetic Bead Capture: An Efficient Selection Method for de novo Protein Engineering Utilizing yeast Surface Display"; Biotechnol. Prog.; vol. 25, No. 3, pp. 774-783 (2009).

(Continued)

*Primary Examiner* — Nicole Kinsey White

(74) *Attorney, Agent, or Firm* — Bozicevic Field & Francis, LLP; Paula A. Borden

(57) ABSTRACT

The present disclosure provides T-cell modulatory multimeric polypeptides that comprise an immunomodulatory polypeptide that exhibits reduced binding affinity to a cognate co-immunomodulatory polypeptide. A T-cell modulatory multimeric polypeptide is useful for modulating the activity of a T cell, and for modulating an immune response in an individual.

18 Claims, 66 Drawing Sheets

Specification includes a Sequence Listing.

(56) References Cited

U.S. PATENT DOCUMENTS

| | | |
|---|---|---|
| 2011/0268737 A1 | 11/2011 | Favier et al. |
| 2011/0318380 A1 | 12/2011 | Brix et al. |
| 2012/0003220 A1 | 1/2012 | Chen |
| 2012/0121577 A1 | 5/2012 | Weidanz et al. |
| 2012/0177595 A1 | 7/2012 | Wong et al. |
| 2012/0264161 A1 | 10/2012 | Scholler et al. |
| 2013/0017199 A1 | 1/2013 | Langermann |
| 2013/0149305 A1 | 6/2013 | Ostrand-Rosenberg |
| 2014/0046026 A1 | 2/2014 | Garcia et al. |
| 2014/0162293 A1 | 6/2014 | Springer et al. |
| 2014/0242077 A1 | 8/2014 | Choi et al. |
| 2015/0071987 A1 | 3/2015 | Selvaraj |
| 2015/0224186 A1 | 8/2015 | Nakagawa |
| 2015/0232532 A1 | 8/2015 | Ostrand-Rosenberg |
| 2015/0374788 A1 | 12/2015 | Paulsen et al. |
| 2016/0011204 A1 | 1/2016 | Almo et al. |
| 2016/0083477 A1 | 3/2016 | Klein et al. |
| 2016/0090407 A1 | 3/2016 | Hosse et al. |
| 2016/0114019 A1 | 4/2016 | Li et al. |
| 2016/0152725 A1 | 6/2016 | Cheung et al. |
| 2016/0175397 A1 | 6/2016 | Umana et al. |
| 2016/0304580 A1 | 10/2016 | Ellmark et al. |
| 2016/0362465 A1 | 12/2016 | Nishimura et al. |
| 2017/0044229 A1 | 2/2017 | Garcia et al. |
| 2017/0058015 A1 | 3/2017 | Seidel, III et al. |
| 2017/0334951 A1 | 11/2017 | O'Reilly et al. |
| 2018/0064795 A1 | 3/2018 | Sugiyama |
| 2018/0086832 A1 | 3/2018 | Vogelstein et al. |
| 2018/0127481 A1 | 5/2018 | Santamaria |
| 2018/0208626 A1 | 7/2018 | Scheinberg et al. |
| 2018/0282392 A1 | 10/2018 | Seidel, III et al. |
| 2018/0339030 A1 | 11/2018 | Scheinberg |
| 2019/0119377 A1 | 4/2019 | Spirig et al. |
| 2022/0162314 A1 | 5/2022 | Yeung et al. |
| 2022/0251202 A1 | 8/2022 | Djuretic et al. |

FOREIGN PATENT DOCUMENTS

| | | |
|---|---|---|
| CN | 101418309 | 4/2009 |
| CN | 101448951 | 6/2009 |
| CN | 101688213 | 3/2010 |
| CN | 105121715 | 12/2015 |
| CN | 108431022 | 11/2016 |
| EP | 3596118 | 1/2020 |
| JP | 2000515363 | 11/2000 |
| JP | 2004501364 | 1/2004 |
| JP | 2005506058 | 3/2005 |
| JP | 2007530021 | 11/2007 |
| JP | 2009537175 | 10/2009 |
| JP | 2010524506 | 7/2010 |
| JP | 2012516854 | 7/2012 |
| JP | 2015537043 | 12/2015 |
| WO | WO 1997/028191 | 8/1997 |
| WO | WO 2001/090747 | 11/2001 |
| WO | WO 2002/072631 | 9/2002 |
| WO | WO 2002/087613 | 11/2002 |
| WO | WO 2002/093129 | 11/2002 |
| WO | WO 2002/102299 | 12/2002 |
| WO | WO 2003/048334 | 6/2003 |
| WO | WO 2004/029197 | 4/2004 |
| WO | WO 2004/111190 | 12/2004 |
| WO | WO 2007/136778 | 11/2007 |
| WO | WO 2008/019888 | 2/2008 |
| WO | WO 2008/113970 | 9/2008 |
| WO | WO 2008/116468 | 10/2008 |
| WO | WO 2008/134461 | 11/2008 |
| WO | WO 2010/037395 | 4/2010 |
| WO | WO 2010/085495 | 7/2010 |
| WO | WO 2010/091122 | 8/2010 |
| WO | WO 2011/066342 | 6/2011 |
| WO | WO 2011/066389 | 6/2011 |
| WO | WO 2012/007951 | 1/2012 |
| WO | WO 2012/127464 | 9/2012 |
| WO | WO 2012/175508 | 12/2012 |
| WO | WO 2013/003761 | 1/2013 |
| WO | WO 2013/079174 | 6/2013 |
| WO | WO 2014/083004 | 6/2014 |
| WO | WO 2014/093118 | 6/2014 |
| WO | WO 2015/007903 | 1/2015 |
| WO | WO 2015/112541 | 7/2015 |
| WO | WO 2015/164815 | 10/2015 |
| WO | WO 2015/195531 | 12/2015 |
| WO | WO 2016/000619 | 1/2016 |
| WO | WO 2016/014428 | 1/2016 |
| WO | WO 2016/025642 | 2/2016 |
| WO | WO 2016/029043 | 2/2016 |
| WO | WO 2016/030350 | 3/2016 |
| WO | WO 2016/141357 | 9/2016 |
| WO | WO 2016/164937 | 10/2016 |
| WO | WO 2016/168771 | 10/2016 |
| WO | WO 2016/198932 | 12/2016 |
| WO | WO 2017/008844 | 1/2017 |
| WO | WO 2017/023779 | 2/2017 |
| WO | WO 2017/059819 | 4/2017 |
| WO | WO 2017/120222 | 7/2017 |
| WO | WO 2017/151818 | 9/2017 |
| WO | WO 2017/151940 | 9/2017 |
| WO | WO 2017/201131 | 11/2017 |
| WO | WO 2017/201210 | 11/2017 |
| WO | WO 2018/119114 | 6/2018 |
| WO | WO 2018/170168 | 9/2018 |
| WO | WO 2019/051126 | 3/2019 |
| WO | WO 2019/051127 | 3/2019 |
| WO | WO 2019/139896 | 7/2019 |
| WO | WO 2020/243315 | 12/2020 |
| WO | WO 2020/247843 | 12/2020 |
| WO | WO 2020/257191 | 12/2020 |
| WO | WO 2021/081239 | 4/2021 |
| WO | WO 2022/087458 | 4/2022 |
| WO | WO 2022/125694 | 6/2022 |
| WO | WO 2022/125711 | 6/2022 |

OTHER PUBLICATIONS

Aina, et al.; "Identification of novel targeting peptides for human ovarian cancer cells using 'one-bead one-compound' combinatorial libraries"; Mol. Cancer Ther.; vol. 4, No. 5, 8 pages (May 2005).

Arduin, et al.; "Highly reduced binding to high and low affinity mouse Fc gamma receptors by L234A/L235A and N297A Fc mutations engineered into mouse IgG2a"; Molecular Immunology; vol. 63, pp. 456-463 (2015).

Azuma, et al.; "B7-H1 is a ubiquitous antiapoptotic receptor on cancer cells"; Immunobiology; vol. 111, No. 7, pp. 3635-3643 (Apr. 1, 2008).

Baldi, et al.; "Recombinant protein production by large-scale transient gene expression in mammalian cells: state of the art and future perspectives"; Biotechnol. Lett.; vol. 29, pp. 677-684 (2007).

Bowers, et al.; "Coupling mammalian cell surface display with somatic hypermutation for the discovery and maturation of human antibodies"; PNAS; vol. 108, No. 51, pp. 20455-20460 (Dec. 20, 2011).

Cafri, et al.; "Development of novel genetic cancer vaccines based on membrane-attached β2 microglobulin"; Ann. N.Y. Acad. Sci.; vol. 1283, pp. 87-90 (2013).

Carey, et al.; "A soluble divalent class I MHC/IgG1 fusion protein activates CD8+ T cells in vivo"; Clinical Immunology; vol. 116, pp. 65-76 (2005).

Cebecauer, et al.; "Soluble MHC-Peptide Complexes Induce Rapid Death of CD8+ CTL"; The Journal of Immunology; vol. 174, pp. 6809-6819 (2005).

Center for Disease Control and Prevention; "How Many Cancers Are Linked with HPV Each Year?"; 4 pages (2016).

Chames, et al.; "Bispecific antibodies for cancer therapy; The light at the end of the tunnel?" mAbs; vol. 1, No. 6, pp. 539-547 (Nov.-Dec. 2009).

Cheever, et al.; "The Prioritization of Cancer Antigens: A National Cancer Institute Pilot Project for the Acceleration of Translational Research"; Clinical Cancer Research; vol. 15, No. 17, pp. 5324-5337 (Sep. 1, 2009).

(56) References Cited

OTHER PUBLICATIONS

Crawford, et al.; "Use of baculovirus MHC/ peptide display libraries to characterize T-cell receptor ligands"; Immunological Reviews; vol. 210, pp. 156-170 (2006).

Crisci, et al.; "Virus-like particles: The new frontier of vaccines for animal viral infections"; Veterinary Immunology and Immunopathology; vol. 148, pp. 211-225 (2012).

Czajkowsky, et al.; "Fc-fusion proteins: new developments and future perspectives"; EMBO Mol. Med.; vol. 4, pp. 1015-1028 (2012).

Das, et al.; "Generation of murine tumor cell lines deficient in MHC molecule surface expression using the CRISPR/Cas9 system"; PLoS One; vol. 12, No. 3, 19 pages (Mar. 16, 2017).

Desmond, et al.; "A systematic review of T-cell epitopes in hepatitis B virus: identification, genotypic variation and relevance to antiviral therapeutics"; Antiviral Therapy; vol. 13, pp. 161-175 (2008).

Dimasi, et al.; "The design and characterization of oligospecific antibodies for simultaneous targeting of multiple disease mediators"; Journal of Molecular Biology; 393(3): p. 672-692 (2009).

Doussal, et al.; "Phage display of peptide /major histocompatibility complex"; Journal of Immunological Methods; vol. 241, pp. 147-158 (2000).

Dulberger, et al.; "Human leukocyte antigen F (HLA-F) presents peptides and regulates immunity through interactions with NK-cell receptors"; Immunity; vol. 46, No. 6, pp. 1018-1027 (Jun. 20, 2017).

Edwards, et al.; "The Remarkable Flexibility of the Human Antibody Repertoire; Isolation of Over One Thousand Different Antibodies to a Single Protein, BLyS"; J. Mol. Biol.; vol. 334, pp. 103-118 (2003).

Engelhard; "Structure of peptides associated with MHC class I molecules"; Current Opinion in Immunology; vol. 6, pp. 13-23 (1994).

GENEBANK:NP_001009066.1; 2 pages (2003).

Goel, et al.; "Plasticity within the Antigen-Combining Site May Manifest as Molecufar Mimicry in the Humoral Immune Response"; The Journal of Immunology; vol. 173, pp. 7358-7367 (2004).

Gough, et al.; "The HLA Region and Autoimmune Disease: Associations and Mechanisms of Action"; Current Genomics; vol. 8, pp. 453-465 (2007).

Greten, et al.; "Peptide-β2-microglobulin-MHC fusion molecules bind antigen-specific T cells and can be used for multivalent MHC-Ig complexes"; Journal of Immunological Methods; vol. 271, pp. 125-135 (2002).

Grupp, et al.; "Adoptive Cellular Therapy"; Curr Top Microbiol Immunol.; 344: p. 149-172 (2011).

Guo, et al.; "Different length peptides bind to HLA-Aw68 similarly at their ends but bulge out in the middle"; Nature; vol. 360, pp. 364-366 (Nov. 26, 1992).

Hansen, et al.; "Phage display of peptide/major histocompatibility class I complexes"; Eur. J. Immunol.; vol. 31, pp. 32-38 (2001).

Huang, et al.; "Bone regeneration in a rat cranial defect with delivery of PEI-condensed plasmid DNA encoding for bone morphogenetic protein-4 (BMP-4)"; Gene Therapy; vol. 12, No. 5, p. 418 (2005).

Huang, et al.; "Cancer immunotherapy using a DNA vaccine encoding a single-chain trimer of MHC class I linked to an HPV-16 E6 immunodominant CTL epitope"; Gene Ther.; vol. 12, No. 15, pp. 1180-1186 (Aug. 2005).

Hug, et al.; "T-cadherin is a receptor for hexameric and high-molecular-weight forms of Acrp30/adiponectin"; PNAS; vol. 101, No. 28, pp. 10308-10313 (Jul. 13, 2004).

Hugues, et al.; "Generation and use of alternative multimers of peptide/MHC complexes"; Journal of Immunological Methods; vol. 268, pp. 83-92 (2002).

Judkowski, et al.; "Identification of MHC Class II-Restricted Peptide Ligands, Including a Glutamic Acid Decarboxylase 65 Sequence, that Stimulate Diabetogenic T Cells from Transgenic BDC2.5 Nonobese Diabetic Mice"; The Journal of Immunology; vol. 166, pp. 908-917 (2001).

Karaki, et al.; "Is There Still Room for Cancer Vaccines at the Era of Checkpoint Inhibitors"; Vaccines; vol. 4, No. 37, 24 pages (2016).

Khan, et al.; "Adjustable Locks and Flexible Keys: Plasticity of Epitope-Paratope Interactions in Germline Antibodies"; The Journal of Immunology; vol. 192, pp. 5398-5405 (2014).

Kim, et al.; "Single chain MHC I trimer-based DNA vaccines for protection against *Listeria monocytogenes* infection"; Vaccine; vol. 30, pp. 2178-2186 (2012).

Krautwurst, et al.; "Identification of Ligands for Olfactory Receptors by Functional Expression of a Receptor Library"; Cell; vol. 95, pp. 917-926 (Dec. 23, 1998).

Kushnir, et al.; "Virus-like particles as a highly efficient vaccine platform: Diversity of targets and production systems and advances in clinical development"; Vaccine; vol. 31, pp. 58-83 (2012).

Lazar-Molnar, et al.; "Crystal structure of the complex between programmed death-1 (PD-1) and its ligand PD-L2"; PNAS; vol. 105, No. 30, pp. 10483-10488 (Jul. 29, 2008).

Lenormand, et al.;"HLA-DQA2and HLA-DQB2 Genes Are Specifically Expressed in Human Langerhans Cells and Encode a New HLA Class II Molecule"; The Journal of Immunology; vol. 199, No. 8, pp. 3903-3911 (Apr. 15, 2012).

Liu, et al.; "Attaining High Transient Titers in CHO Cells"; Genetic Engineering & Biotechnology News; vol. 35, No. 17, 3 pages (Oct. 1, 2015).

Lloyd, et al.; "Modelling the human immune response: performance of a 1011 human antibody repertoire against a broad panel of therapeutically relevant antigens"; Protein Engineering, Design & Selection; vol. 22, No. 3, pp. 159-168 (2009).

Mallone, et al.; "T Cell Recognition of Autoantigens in Human Type 1 Diabetes: Clinical Perspectives"; Clinical and Developmental Immunology; vol. 2011, 16 pages (2011).

Margalit, et al.; "Induction of Antitumor Immunity by CTL Epitopes Genetically Linked to Membrane-Anchored P2-Microglobulin"; The Journal of Immunology; vol. 176, pp. 217-224 (2006).

McAllister, et al.; "Adaptation of Recombinant HEK-293 Cells to Growth in Serum Free Suspension"; Animal Cell Technology: Products from Cells, Cells as Products; 3 pages (1999).

Medina, et al.; "PD-1 Pathway Inhibitors: Immuno-Onology Agents for Restoring Anititumor Immune Responses"; Pharmacotherapy; vol. 36, No. 3, pp. 317-334 (2016).

Miao, et al.; "Transient expression of fluorescent fusion proteins in protoplasts of suspension cultured cells"; Nature Protocols; vol. 2, No. 10, pp. 2348-2353 (2007).

Mizukoshi, et al.; "Identification of α-fetoprotein-derived peptides recognized by cytotoxic T lymphocytes in HLA-A24+ patients with hepatocellular carcinoma"; Int. J. Cancer; vol. 118, pp. 1194-1204 (2006).

Mott, et al.; "The Solution Structure of the F42A Mutant of Human Interleukin 2"; J. Mol. Biol.; vol. 247, pp. 979-994 (1995).

Muller, et al.; "Random peptide libraries displayed on adeno-associated virus to select for targeted gene therapy vectors"; Nature Biotechnology; vol. 21, No. 9, pp. 1040-1046 (Sep. 2003).

Naidoo, et al.; "Toxicities of the anti-PD-1 and anti-PD-L1 immune checkpoint antibodies"; Annals of Oncology; vol. 26, pp. 2375-2391 (2015).

Nielsen, et al.; "MHC Class II epitope predictive algorithms"; Immunology; vol. 130, pp. 319-328 (2010).

Oates, et al.; "ImmTACs: Novel bi-specific agents for targeted cancer therapy"; OncoImmunology; vol. 2, No. 2, 3 pages (Feb. 2013).

Obermann, et al.; "Peptide-β2-microglobulin-major histocompatibility complex expressing cells are potent antigen-presenting cells that can generate specific T cells"; Immunology; vol. 122, pp. 90-97 (2007).

Oka, et al.; "Induction of WT1 (Wilms' tumor gene)-specific cytotoxic T lymphocytes by WT1 peptide vaccine and the resultant cancer regression"; PNAS; vol. 101, No. 38, pp. 13885-13890 (Sep. 21, 2004).

Oliveira, et al.; "Design, Immune Responses and Anti-Tumor Potential of an HPV16 E6E7 Multi-Epitope Vaccine"; PLoS One; vol. 10, No. 9, 13 pages (Sep. 21, 2015).

(56) References Cited

OTHER PUBLICATIONS

Peach, et al.; "Both Extracellular Immunoglobin-like Domains of CD80 Contain Residues Critical for Binding T Cell Surface Receptors CTLA-4 and CD28*"; The Journal of Biological Chemistry; vol. 270, No. 36, pp. 21181-21187 (1995).
Ponstingl, et al.; "The Rule of Antibody Structure: The Primary Structure of a Monoclonal IgG1 Immunoglobulin (Myeloma Protein Nie)"; Hoppe Seylers Z Physiol Chem.; vol. 357, No. 11, pp. 1571-1604 (Nov. 1976). [English translation of Abstract Only].
Poosarla, et al.; "Computational De Novo Design of Antibodies Binding to a Peptide With High Affinity"; Biotechnology & Bioengineering; vol. 114, No. 6, pp. 1331-1342 (Jun. 2017).
Quayle, et al.; "CUE-101, a Novel HPV16 E7-pHLA-IL-2-Fc Fusion Protein, Enhances Tumor Antigen Specific T Cell Activation for the Treatment of HPV16-Driven Malignancies"; Clinical Cancer Research; vol. 26, No. 8, pp. 1953-1964 (Jan. 21, 2020).
Rabu, et al.; "Production of recombinant human trimeric CD137L (4-1 BBL). Cross-linking is essential to its T cell co-stimulation activity"; The Journal of Biological Chemistry; vol. 280, No. 50, pp. 41472-41481 (Dec. 16, 2005).
Ramani, et al.; "A secreted protein microarray platform for extracellular protein interaction discovery"; Analytical Biochemistry; vol. 420, pp. 127-138 (2012).
Reche, et al.; "Sequence Variability Analysis of Human Class I and Class II MHC Molecules: Functional and Structural Correlates of Amino Acid Polymorphisms"; Journal of Molecular Biology; vol. 331, No. 3, pp. 623-641 (Aug. 15, 2003).
Ressing, et al.; "Human CTL epitopes encoded by human papillomavirus type 16 E6 and E7 identified through in vivo and in vitro immunogenicity studies of HLA-A*0201 -binding peptides"; The Journal of Immunology; vol. 154, pp. 5934-5943 (1995).
Rocha-Zavaleta, et al.; "Interleukin-2 (IL-2) receptor-βγ signalling is activated by c-Kit in the absence of IL-2, or by exogenous IL-2 via JAK3/STAT5 in human papillomavirus-associated cervical cancer"; Cellular Signalling; vol. 16, pp. 1239-1247 (2004).
Schmittnaegel, et al.; "A New Class of Bifunctional Major Histocompatibility Class I Antibody Fusion Molecules to Redirect CD8 T Cells"; Molecular Cancer Therapeutics; vol. 15, No. 9, pp. 2130-2142 (Sep. 2016).
Shah, et al.; "Bio-layer Interferometry for Measuring Kinetics of Protein-protein Interactions and Allosteric Ligand Effects"; Journal of Visualized Experiments; vol. 84, 11 pages (2014).
Sharma, et al.; "A synthetic chimeric peptide harboring human papillomavirus 16 cytotoxic T lymphocyte epitopes shows therapeutic potential in a murine model of cervical cancer"; Immunologic Research; 58(1): p. 132-138 (2014).
Spang, et al.; "Heterodimeric Barnase-Barstar Vaccine Molecules: Influence of One versus Two Targeting Units Specific for Antigen Presenting Cells"; PLoS One; vol. 7, No. 9, 11 pages (Sep. 2012).
Stadinski, et al.; "Diabetogenic T cells recognize insulin bound to IAg7 in an unexpected, weakly binding register"; PNAS; vol. 107, No. 24, pp. 10978-10983 (Jun. 15, 2010).
Stamper, et al.; "Crystal structure of the B7-1/CTLA-4 complex that inhibits human immune responses"; Nature; vol. 410, pp. 608-611 (Mar. 29, 2001).
Taube, et al.; "Lentivirus Display: Stable Expression of Human Antibodies on the Surface of Human Cells and Virus Particles"; PLoS One; vol. 3, No. 9, 12 pages (Sep. 2008).
Tham, et al.; "Activation of antigen-specific T cells by artificial cell constructs having immobilized multimeric peptide—class I complexes and recombinant B7-Fc proteins"; Journal of Immunological Methods; vol. 249, pp. 111-119 (2001).
Torres, et al.; "The immunoglobulin constant region contributes to affinity and specificity"; Trends in Immunology; vol. 29, No. 2, pp. 91-97 (Jan. 10, 2008).
Toukam, et al.; "Targeting Antibody Responses to the Membrane Proximal External Region of the Envelope Glycoprotein of Human Immunodeficiency Virus"; PLoS One; vol. 7, No. 5, 10 pages (May 2012).
Trolle, et al.; "The length distribution of class I restricted T cell epitopes is determined by both peptide supply and MHC allele specific binding preference"; J Immunol; vol. 196, No. 4, pp. 1480-1487 (Feb. 15, 2016).
Van Der Burg, et al.; "An HLA Class I Peptide-Binding Assay Based on Competition for Binding to Class I Molecules on Intact Human B Cells Identification of Conserved HIV-1 Polymerase Peptides Binding to HLA-A*0301"; Hum. Immunol.; vol. 44, No. 4, pp. 189-198 (Dec. 1995).
Venkatakrishnan, et al.; "The Structural Biology of Hepatitis B Virus: Form and Function"; Annu. Rev. Virol.; vol. 3, No. 1, pp. 429-451 (Sep. 29, 2016).
Wang, et al.; "Molcular Modeling and Functional Mapping of B7-H1 and B7-DC Uncouple Costimulatory Function from PD-1 Interaction"; J. Exp. Med.; vol. 197, No. 9, pp. 1083-1091 (May 5, 2003).
Wang, et al.; "Using a baculovirus display library to identify MHC class I mimotopes"; PNAS; vol. 102, No. 7, pp. 2476-2481 (Feb. 15, 2005).
Wen, et al.; "Construction and screening of an antigen-derived peptide library displayed on yeast cell surface for CD4+ T cell epitope identification"; Methods Mol. Biol.; vol. 1061, pp. 245-264 (2013).
Whitehead, et al.; "Optimization of affinity, specificity and function of designed influenza inhibitors using deep sequencing"; Nat. Biotechnol.; vol. 30, No. 6, pp. 543-548 (Apr. 29, 2013).
Won, et al.; "The structure of the trimer of human 4-1BB ligand is unique among members of the tumor necrosis factor superfamily"; J Biol Chem; vol. 285, No. 12, pp. 9202-9210 (Mar. 19, 2010).
Wu, et al.; "Simultaneous targeting of multiple disease mediators by a dual-variable-domain immunoglobulin"; Nature Biotechnology; 25: p. 1290-1297 (2007).
Xu, et al.; "Cytokine release syndrome in cancer immunotherapy with chimeric antigen receptor engineered T cells"; Cancer Letters; 343(2): p. 172-178 (2014).
Zheng, et al.; "B7-CTLA4 interaction enhances both production of antitumor cytotoxic T lymphocytes and resistance to tumor challenge"; PNAS; vol. 95, pp. 6284-6289 (May 1998).
Ziauddin, et al.; "Microarrays of cells expressing defined cDNAs"; Nature; vol. 411, pp. 107-110 (May 3, 2011).
Card, et al.; "A soluble single-chain T-cell receptor IL-2 fusion protein retains MHC-restricted peptide specificity and IL-2 bioactivity"; Cancer Immunol Immunother; vol. 53, pp. 345-357 (Nov. 11, 2003).
Engler, et al.; "Peptide vaccines against hepatitis B virus: from animal model to human studies"; Molecular Immunology; vol. 38, pp. 457-465 (Dec. 2001).
PDB:1I8L_A; "Chain A, T Lymphocyte Activation Antigen Cd80" 2 pages (Dec. 27, 2012).
Quayle, et al.; "Immuno-STAT(TM) (Selective Targeting and Alteration of T cells) Platform: Targeting Tumor Heterogeneity and Tumor Escape Mechanisms"; DOI:10.1158/1078-0432.CCR-19-3354; URL:https://www.cuebiopharma.com/our-appro ch/scien ific-presentatjons-publications/; 1 page (Jan. 21, 2020).
Seidel, et al.; "Peptide-HLA-based immunotherapeutics platforms for direct modulation of antigen-specific T cells"; Scientific Reports; vol. 11, No. 19220, 8 pages (Sep. 2021).
GENBANK:AEV43323.1; "Fc IgG1 heavy chain constant region, partial [Homo sapiens]"; 2 pages (Jul. 25, 2016).
Kreiter, et al.; "Increased Antigen Presentation Efficiency by Coupling Antigens to MHC Class I Trafficking Signals"; The Journal of Immunology; vol. 180, No. 1, pp. 309-318 (Jan. 1, 2008).
Strohl; "Optimization of Fc-mediated effector functions of monoclonal antibodies"; Current Opinion in Biotechnology; vol. 20, pp. 685-691 (2009).
Lazar-Molnar, et al.; "The PD-1/PD-L costimulatory pathway critically affects host resistance to the pathogenic fungus *Histoplasma capsulatum*"; PNAS; vol. 105, No. 7, pp. 2658-2663 (Feb. 19, 2008).
Büttner; "Cell-based assays for high-throughput screening"; Expert Opin. Drug Discov..; vol. 1, No. 4, pp. 301-306 (Sep. 2006).
GENBANK:NP_068693.1; "programmed cell death 1 ligand 1 precursor [Mus musculus]"; 3 pages (Jun. 9, 2021).

(56) References Cited

OTHER PUBLICATIONS

GENBANK:NP_001300958.1; "programmed cell death 1 ligand 1 isoform c precursor [*Homo sapiens*]"; 3 pages (Jun. 9, 2021).
Liao, et al.; "Interleukin-2 at the Crossroads of Effector Responses, Tolerance, and Immunotherapy"; Immunity; vol. 38, No. 1, pp. 13-25 (Jan. 1, 2013).
McNally, et al.; "CD4+CD25+ regulatory T cells control CD8+ T-cell effector differentiation by modulating IL-2 homeostasis"; PNAS; vol. 108, No. 18, pp. 7529-7534 (May 3, 2011).
Tafuro, et al.; "Reconstitution of antigen presentation in HLA class I-negative cancer cells with peptide-β2m fusion molecules"; Eur. J. Immunol.; vol. 31, pp. 440-449 (2001).
Buonaguro, et al.; "Translating Tumor Antigens into Cancer Vaccines"; Clinical and Vaccine Immunology; vol. 18, No. 1, pp. 23-24 (Jan. 2011).
Celis, et al.; "Identification of Potential CTL Epitopes of Tumor-Associated Antigen Mage-1 for Five Common HLA-A Alleles"; Molecular Immunology; vol. 31, No. 18, pp. 1423-1430 (1994).
De Charette, et al.; "Turning tumour cells into antigen presenting cells: The next step to improve cancer immunotherapy?"; European Journal of Cancer; vol. 68, pp. 134-147 (2016).
HLA Nomenclature; "HLA Alleles Numbers"; 2 pages (Mar. 17, 2015).
Karin, et al.; "Reversal of Experimental Autoimmune Encephalomyelitis by a Soluble Peptide Variant of a Myelin Basic Protein Epitope: T Cell Receptor Antagonism and Reduction of Interferon γ and Tumor Necrosis Factor α Production"; J. Exp. Med.; vol. 180, pp. 2227-2237 (Dec. 1994).
Martin-Orozco, et al.; "Melanoma Cells Express ICOS Ligand to Promote the Activation and Expansion of T-Regulatory Cells"; Cancer Research; vol. 70, No. 23, pp. 9581-9590 (2010).
Motz, et al.; "Tumor Endothelium FasL Establishes a Selective Immune Barrier Promoting Tolerance in Tumors"; Nat. Med.; vol. 20, No. 6, pp. 607-615 (Jun. 2014).
Ochoa-Garay, et al.; "The Ability of Peptides to Induce Cytotoxic T Cells In Vitro Does Not Strongly Correlate with Their Affinity for the H-2L$^d$ Molecule: Implications for Vaccine Design and Immunotherapy"; Molecular Immunology; vol. 34, No. 3, pp. 273-281 (1997).
Repana, et al.; "The Network of Cancer Genes (NCG): a comprehensive catalogue of known and candidate cancer genes from cancer sequencing screens"; Genome Biology; vol. 20, No. 1, 12 pages (2019).
Schumacher, et al.; "Neoantigens in cancer immunotherapy"; Science; vol. 348, No. 6230, pp. 69-74 (Apr. 2, 2015).
White, et al.; "Soluble Class I MHC with β$_2$-MicroglobulinCovalently Linked Peptides: Specific Binding to a T Cell Hybridoma"; J Immunol; vol. 162, pp. 2671-2676 (1999).
Lin, et al.; "The PD-1/PD-L1 complex resembles the antigen-binding Fv domains of antibodies and T cell receptors"; PNAS; vol. 105, No. 8, pp. 3011-3016 (Feb. 26, 2008).
Brophy, et al.; "A yeast display system for engineering functional peptide-MHC complexes"; Journal of Immunological Methods; vol. 272, pp. 235-246 (2003).
Emboss Needle; 2 pages (Feb. 10, 2022).
GenCore AEE04235; 4 pages (2005).
Liu, et al.; "Major Histocompatibility Complex: Interaction with Peptides"; eLS; 12 pages (Aug. 15, 2011).

Mottez, et al.; "Cells Expressing a Major Histocompatibility Complex Class I Molecule with a Single Covalently Bound Peptide Are Highly Immunogenic"; J. Exp. Med.; vol. 181, pp. 493-502 (Feb. 1995).
Vitello, et al.; "Neoantigen prediction and the need for validation"; Nature Biotechnology; vol. 35, No. 9, pp. 815-817 (Sep. 2017).
Wieczorek, et al.; "Major Histocompatibility Complex (MHC) Class I and MHC Class II Proteins: Conformational Plasticity in Antigen Presentation"; Frontiers in Immunology; vol. 8, No. 292, pp. 1-16 (Mar. 2017).
Accession No. 1 IRL_A chain A Interleukin-2; 1 page (Aug. 25, 1995).
Solinas, et al.; "The rationale behind targeting the ICOS-ICOS ligand costimulatory pathway in cancer immunotherapy"; ESMO Open; vol. 5, 7 pages (Jan. 2020).
Preda, et al.; "Soluble, dimeric HLA DR4-peptide chimeras: An approach for detection and immunoregulation of human type-1 diabetes"; Eur. J. Immunol.; vol. 35, pp. 2763-2776 (Aug. 16, 2005).
Woodham, et al.; "In vivo detection of antigen-specific CD8T cells by immuno-positron emission tomography"; Nat Methods.; vol. 17, No. 10, pp. 1025-1032 (Oct. 2020).
Bresson, et al; "Anti-CD3 and nasal proinsulin combination therapy enhances remission from recent-onset autoimmune diabetes by inducing Tregs"; The Journal of Clinical Investigation; vol. 116, No. 5, pp. 1371-1381 (May 2006).
Casares, et al.; "A Peptide-Major Histocompatibility Complex II Chimera Favors Survival of Pancreatic β-Islets Grafted in Type 1 Diabetic Mice"; Transplantation; vol. 85, No. 12, pp. 1717-1725 (Jun. 27, 2008).
Durinovic-Bello, et al.; "DRB1*0401-restricted human T cell clone specific for the major proinsulin73-90 epitope expresses a down-regulatory T helper 2 phenotype"; PNAS; vol. 103, No. 31, pp. 11683-11688 (Aug. 1, 2006).
Gojanovich, et al.; "The Use of Peptide-Major-Histocompatibility-Complex Multimers in Type 1 Diabetes Mellitus"; Journal of Diabetes Science and Technology; vol. 6, No. 3, pp. 515-524 (May 2012).
Li, et al.; "Suppression of Ongoing T Cell-Mediated Autoimmunity by Peptide-MHC Class II Dimer Vaccination"; The Journal of Immunology; vol. 183, pp. 4809-4816 (Sep. 14, 2009).
Lin, et al.; "Reversal of type 1 diabetes by a new MHC II-peptide chimera: "Single-epitope-mediated suppression" to stabilize a polyclonal autoimmune T-cell process"; Eur. J. Immunol.; vol. 40, pp. 2277-2288 (2010).
Michels, et al.; "Islet-Derived CD4 T Cells Targeting Proinsulin in Human Autoimmune Diabetes"; Diabetes; vol. 66, pp. 722-734 (Mar. 2017).
Sang, et al.; "Long-term silencing of autoimmune diabetes and improved life expectancy by a soluble pHLA-DR4 chimera in a newly-humanized NOD-DR4/B7 mouse"; Human Vaccines & Immunotherapeutics; vol. 10, No. 3, pp. 693-699 (Mar. 2014).
Tan, et al.; "Type 1 diabetes induction in humanized mice"; PNAS; vol. 114, No. 41, pp. 10954-10959 (Oct. 10, 2017).
Zhang, et al.; "Monoclonal antibody blocking the recognition of an insulin peptide-MHC complex modulates type 1 diabetes"; PNAS; vol. 111, No. 7, pp. 2656-2661 (Feb. 18, 2014).
Stauber et al.; "Crystal structure of the IL-2 signaling complex: Paradigm for a heterotrimeric cytokine receptor"; Proc. Natl. Acad. Sci.; vol. 103, No. 8, pp. 2788-2793 (Feb. 21, 2006).
Unverdorben, et al.; "Pharmacokinetic properties of IgG and various Fc fusion proteins in mice"; MABS; vol. 8, No. 1, pp. 120-128 (Oct. 29, 2015).

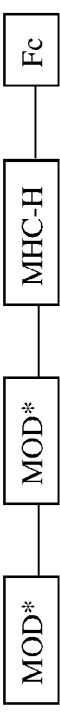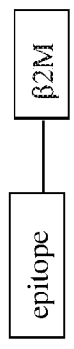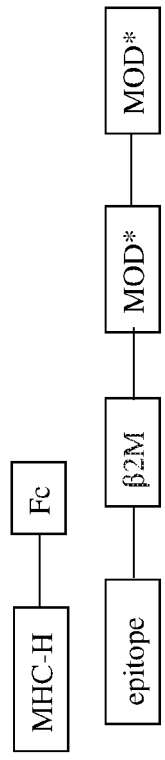
FIG.2A
FIG.2B
FIG.2C

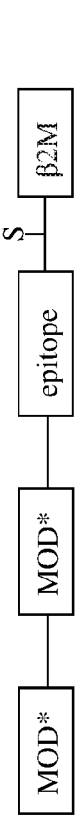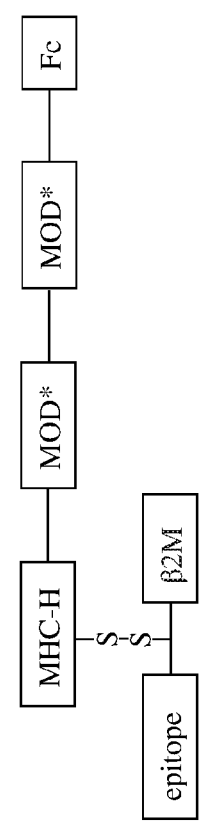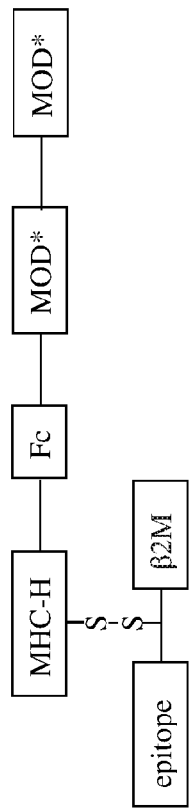
FIG.3D
FIG.3E
FIG.3F

FIG. 4A

HBV large surface antigen (L-HBsAg)

```
  1 MWLIITSRRD IIYTLFGRRV SYIKESPHVA PHFAGHHILG NKIYSMGGWS SKPRKGMGTN
 61 LSVPNPLGFF PDHQLDPAFK ANSDNPDWDL NPHKDNWPDA NKVGVGAFGP GFIPSHGGLL
121 GWSPKAQGIL TVVPAASLLA STIGKSGRQP TPLSPPLRDT HPQAMQWNST TFHQTLQDPR
181 VRALYFPAGG SSSGTVSPAQ NTVSAISSIL SKTGDPVPNM ENIASGLLGP LLVLQAGFFL
241 LTKILTIPQS LDSWWTSLNF LGGTPVCLGQ NSQSQISSHS PTCCPPICPG YRWMCLRRFI
301 IFLCILLLCL IFLLVLLDYQ GMLPVCPLIP GSSTTSTGPC KTCTTPAQGT SMFTSCCCTK
361 PTDGNCTCIP IPSSWAFAKY LWEWASVRFS WLSLLVPFVQ WFVGLSPTVW LSVIWMWYW
421 GPSLYNILSP FMPLLPIFFC LWVYI
```

FIG. 4B

HBV middle surface antigen (M-HBsAg)

```
  1 MQWNSSTFHQ ALLDPRVRGL YFPAGGSSSG TVNPVPTTAS PISSIFSRTG DPAPNMESTT
 61 SGFLGPLLVL QAGFFLLTRI LTIPQSLDSW WTSLNFLGGA PTCPGQNLQS PTSNHSQTSC
121 PPICPGYRWM CLRRFIIFLF ILLLCLIFLL VLLDYQGMLP VCPLLPGTST TSTGPCKTCT
181 TPAQGTSMFP SCCCTKPSDG NCTCIPIPSS WAFARFLWEW ASVRFSWLSL LVPFVQWFVG
241 LSPTVWLSVI WMMWYWGPSL YNILNPFLPL LPIFFCLWVY I
```

FIG. 4C

HBV small surface antigen (S-HBsAg)

```
  1 MESTTSGFLG PLLVLQAGFF LLTRILTIPQ SLDSWWTSLN FLGGAPTCPG QNLQSPTSNH
 61 SQTSCPPICP GYRWMCLRRF IIFLFILLLC LIFLLVLLDY QGMLPVCPLL PGTSTSTGP
121 CKTCTTPAQG TSMFPSCCCT KPSDGNCTCI PIPSSWAFAR FLWEWASVRF SWLSLLVPFV
181 QWFVGLSPTV WLSVIWMMWY WGPSLYNILN PFLPLLPIFF CLWVYI
```

FIG. 4D

HBV polymerase

```
  1 MPLSYQHFRK LLLLDEEAGP LEEELPRLAD EGLNRRVAED LNLGNLNVSI PWTHKVGNFT
 61 GLYSSTVPCF NPKWQTPSFP DIHLQEDIVD RCKQFVGPLT VNENRRLKLI MPARFYPNVT
121 KYLPLDKGIK PYYPEHVVNH YFQTRHYLHT LWKAGILYKR ESTRSASFCG SPYSWEQDLQ
181 HGRLVFKTSK RHGDKSFCPQ SPGILPRSSV GPCIQSQLRK SRLGPQPAQG QLAGRQQGGS
241 GSIRARVHPS PWGTVGVEPS GSGHTHNCAS SSSSCLHQSA VRKAAYSLIS TSKGHSSSGH
301 AVELHHFPPN SSRSQSQGPV LSCWWLQFRN SEPCSEYCLC HIVNLIEDWG PCTEHGEHRI
361 RTPRTPARVT GGVFLVDKNP HNTTESRLVV DFSQFSRGDT RVSWPKFAVP NLQSLTNLLS
421 SNLSWLSLDV SAAFYHLPLH PAAMPHLLVG SSGLSRYVAR LSSNSRIINN QHRTMQNLHN
481 SCSRNLYVSL MLLYKTYGRK LHLYSHPIIL GFRKIPMGVG LSPFLLAQFT SAICSVVRRA
541 FPHCLAFSYM DDVVLGAKSV QHLESLYAAV TNFLLSLGIH LNPHKTKRWG YSLNFMGYVI
601 GCWGTMPQEH IVQKIKMCFR KLPVNRPIDW KVCQRIVGLL GFAAPFTQCG YPALMPLYAC
661 IQAKQAFTFS PTYKAFLSKQ YLNLYPVARQ RSGLCQVFAD ATPTGWGLAI GHQRMRGTFV
721 SPLPIHTAEL LAACFARSRS GAKLIGTDNS VVLSRKYTSF PWLLGCAANW ILRGTSFVYV
781 PSALNPADDP SRGRLGLYRP LLRLLYRPTT GRTSLYADSP SVPSHLPDRV HFASPLHVAW
841 RPP
```

FIG. 4E

HBV core

```
  1 MDIDPYKEFG ASAELLSFLP SDFFPSVRDL LDTAKALFQE ALESPEHCSP HHTALRQAIL
 61 CWGDLMTLAT WVGANLEDPA SRDLVVNYVN TTAGLKFRQL LWFHISCLTF GRETVIEYLV
121 SFGVWIRTPP PYRPPNAPIL STLPETTVVR YRDRGRSTRR RTPSPRRRRS QSPRRRRSQS
181 RESQC
```

FIG. 4F

HBV precore

```
  1 MQLFHLCLII SCSCPTVQAS KLCLGMLWGM DIDPYKEFGA SAELLSFLPS DFFPSIRDLL
 61 DTASALYREA LESPEHCSPH HTALRQAILC WGELMNLATW VGSNLEDPAS RELVVSYVNV
121 NMGLKIRQLL WFHISCLTFG RETVLEYLVS FGVWIRTPPA YRPPNAPILS TLPETTVVRR
181 RGRSPRRRTP SPRRRRSQSP RRRRSQSRGS QC
```

FIG. 4G

HBV X protein

```
  1 MAARLCCQLD PARDVLCLRP VGAESCGRPF SGSLGTLSSP SPSAVPTDHG AHLSLRGLPV
 61 CAFSSAGPCA LRFTSARRME TTVNAHQILP KVLHKRTLGL SAMSTTDLEA YFKDCLFKDW
121 EELGEEIRLK VFVLGGCRHK LVCAPAPCNF FTSA
```

FIG. 5A

GenBank 3S7G_A
*Homo sapiens* IgG1 Fc (SEQ ID NO:204)
227 aa

```
  1 dkthtcppcp apellggpsv flfppkpkdt lmisrtpevt cvvvdvshed pevkfnwyvd
 61 gvevhnaktk preeqynsty rvvsvltvlh qdwlngkeyk ckvsnkalpa piektiskak
121 gqprepqvyt lppsrdeltk nqvsltclvk gfypsdiave wesngqpenn ykttppvlds
181 dgsfflyskl tvdksrwqqg nvfscsvmhe alhnhytqks lslspgk
```

GenBank AAN76044
*Homo sapiens* IgG2 Fc (amino acids 99-325) (SEQ ID NO:205)
227 aa

```
  1 stkgpsvfpl apcsrstses taalgclvkd yfpepvtvsw nsgaltsgvh tfpavlqssg
 61 lyslssvvtv pssnfgtqty tcnvdhkpsn tkvdktverk ccvecppcpa ppvagpsvfl
121 fppkpkdtlm isrtpevtcv vvdvshedpe vqfnwyvdgv evhnaktkpr eeqfnstfrv
181 vsvltvvhqd wlngkeykck vsnkglpapi ektisktkgq prepqvytlp psreemtknq
241 vsltclvkgf ypsdiavewe sngqpennyk ttppmldsdg sfflysklvt dksrwqqgnv
301 fscsvmheal hnhytqksls lspgk
```

GenBank AAW65947
*Homo sapiens* IgG3 Fc (amino acids 19-246) (SEQ ID NO:206)
238 aa

```
  1 hkpsntkvdk rvelktplgd tthtcppcpa pellggpsvf lfppkpkdtl misrtpevtc
 61 vvvdvshedp evkfnwyvdg vevhnaktkp reeqynstyr vvsvltvlhq dwlngkeykc
121 kvsnkalpap iektiskakg qprepqvytl ppsrdeltkn qvsltclvkg fypsdiavew
181 esngqpenny kttppvldsd gsfflysklt vdksrwqqgn vfscsvmhea lhnhytqksl
241 slspgk
```

FIG. 5B

GenBank AAA52770
*Homo sapiens* IgD Fc (amino acids 162-383) (SEQ ID NO:207)
222 aa

```
  1 ptkapdvfpi isgcrhpkdn spvvlaclit gyhptsvtvt wymgtqsqpq rtfpeiqrrd
 61 syymtssqls tplqqwrgge ykcvvqhtas kskkeifrwp espkaqassv ptaqpqaegs
121 lakattapat trntgrggee kkkekekeeq eeretktpec pshtqplgvy lltpavqdlw
181 lrdkatftcf vvgsdlkdah ltwevagkvp tggveeglle rhsngsqsqh srltlprslw
241 nagtsvtctl nhpslppqrl malrepaaga pvkslnlla ssdppeaasw llcevsgfsp
301 pnilmwled qrevntsgfa parpppqprs ttfwawsvlr vpappspqpa tytcvvshed
361 srtlnasrs levsyvtdhg pmk
```

GenBank O308221A
*Homo sapiens* IgM Fc (SEQ ID NO:208)
276 aa

```
  1 vtstltikzs dwlgesmftc rvdhrgltfq qnassmcvpd qdtairvfai ppsfasiflt
 61 kstkltclvt dlttybsvti swtreengav kthtnisesh pnatfsavge asicedbdws
121 gerftctvth tdlpsplkqt isrpkgvalh rpbvyllppa rzzlnlresa titclvtgfs
181 padvfvewmq rgeplspqky vtsapmpepq apgryfahsi ltvseeewnt ggtytcvvah
241 ealpnrvter tvdkstgkpt lynvslvmsd tagtcy
```

FIG. 5C

GenBank P01876
*Homo sapiens* IgA Fc (amino acids 120-353) (SEQ ID NO:209)
234 aa

```
  1 asptspkvfp lslcstqpdg nvviaclvqg ffpqeplsvt wsesgqgvta rnfppsqdas
 61 gdlyttssql tlpatqclag ksvtchvkhy tnpsqdvtvp cpvpstpptp spstpptpsp
121 scchprlslh rpaledlilg seanltctlt glrdasgvtf twtpssgksa vqgpperdlc
181 gcysvssvlp gcaepwnhgk tftctaaype sktpltatls ksgntfrpev hllpppseel
241 alnelvtltc largfspkdv lvrwlqgsqe lprekyltwa srqepsqgtt tfavtsilrv
301 aaedwkkgdt fscmvgheal plaftqktid rlagkpthvn vsvvmaevdg tcy
```

GenBank 1F6A_B
*Homo sapiens* IgE Fc (amino acids 6-222) (SEQ ID NO:210)
212 aa

```
  1 adpcdsnprg vsaylsrpsp fdlfirkspt itclvvdlap skgtvnltws rasgkpvnhs
 61 trkeekqrng tltvtstlpv gtrdwieget yqcrvthphl pralmrsttk tsgpraapev
121 yafatpewpg srdkrtlacl iqnfmpedis vqwlhnevql pdarhsttqp rktkgsgffv
181 fsrlevtrae weqkdeficr avheaaspsq tvqravsvnp gk
```

GenBank P01861
*Homo sapiens* IgG4 Fc (amino acids 100-327) (SEQ ID NO:211)
228 aa

```
  1 astkgpsvfp lapcsrstse staalgclvk dyfpepvtvs wnsgaltsgv htfpavlqss
 61 glyslssvvt vpssslgtkt ytcnvdhkps ntkvdkrves kygppcpscp apeflggpsv
121 flfppkpkdt lmisrtpevt cvvvdvsqed pevqfnwyvd gvevhnaktk preeqfnsty
181 rvvsvltvlh qdwlngkeyk ckvsnkglps siektiskak gqprepqvyt lppsqeemtk
241 nqvsltclvk gfypsdiave wesngqpenn ykttppvlds dgsfflysrl tvdksrwqeg
301 nvfscsvmhe alhnhytqks lslsgk
```

FIG. 5D WT Human IgG1 Fc Sequence:

DKTHTCPPCPAPELLGGPSVFLFPPKPKDTLMISRTPEVTCVVVDVSHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK (SEQ ID NO:212)

FIG. 5E

Human IgG1 Fc Mutant: L234F/L235E/P331S (Triple Mutant TM )

DKTHTCPPCPAPEFEGGPSVFLFPPKPKDTLMISRTPEVTCVVVDVSHEDPEVKFNWYVDGVEVHNAKTKPREEQYNSTY
RVVSVLTVLHQDWLNGKEYKCKVSNKALPASIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK (SEQ ID NO:213)

FIG. 5F

Human IgG1 Fc Mutant: N297A

DKTHTCPPCPAPELLGGPSVFLFPPKPKDTLMISRTPEVTCVVVDVSHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK (SEQ ID NO:214)

FIG. 5G

Human IgG1 Fc Mutant: L234A/L235A ( LALA )

DKTHTCPPCPAPEAAGGPSVFLFPPKPKDTLMISRTPEVTCVVVDVSHEDPEVKFNWYVDGVEVHNAKTKPREEQYNST
YRVVSVLTVLHQDWLNGKEYKCKVSNKALPAPIEKTISKAKGQPAPIEKTISKAKGQPREPQVYTLPPSREEMTKNQVSLTCLVKGFYPSDIAVE
WESNGQPENNYKTTPPVLDSDGSFFLYSKLTVDKSRWQQGNVFSCSVMHEALHNHYTQKSLSLSPGK (SEQ ID
NO:215)

Residue numbered according to EU index (Kabat Numbering)

FIG. 6A

*Homo sapiens*
GenBank NP_001229687
HLA-A
Amino acids 25-365 (SEQ ID NO:216)

```
  1 mavmaprtll lllsgalalt qtwagshsmr yfftsvsrpg rgeprfiavg yvddtqfvrf
 61 dsdaasqkme prapwieqeg peywdqetrn mkahsqtdra nlgtlrgyyn qsedgshtlq
121 imygcdvgpd grflrgyrqd aydgkdyial nedlrswtaa dmaaqitkrk weavhaaeqr
181 rvylegrcvd glrrylengk etlqrtdppk thmthhpisd heatlrcwal gfypaeitlt
241 wqrdgedqtq dtelvetrpa gdgtfqkwaa vvvpsgeeqr ytchvqhegl pkpltlrwel
301 ssqptipivg iiaglvllga vitgavvaav mwrrkssdrk ggsytqaass dsaggsdvsl
361 tackv
```

FIG. 6B

*Homo sapiens*
GenBank NP_005505
HLA-B
Amino acids 25-362 (SEQ ID NO:217)

```
  1 mlvmaprtvl lllsaalalt etwagshsmr yfytsvsrpg rgeprfisvg yvddtqfvrf
 61 dsdaaspree prapwieqeg peywdrntqi ykaqaqtdre slrnlrgyyn qseagshtlq
121 smygcdvgpd grlrghdqy aydgkdyial nedlrswtaa dtaaqitqrk weaareaeqr
181 raylegecve wlrrylengk dkleradppk thvthhpisd heatlrcwal gfypaeitlt
241 wqrdgedqtq dtelvetrpa gdrtfqkwaa vvvpsgeeqr ytchvqhegl pkpltlrwep
301 ssqstvpivg ivaglavlav vvigavvaav mcrrkssggk ggsysqaacs dsaggsdvsl
361 ta
```

FIG. 6C

*Homo sapiens*
GenBank NP_001229971
HLA-C
Amino acids 25-366 (SEQ ID NO:218)

```
  1 mrvmaprall lllsgglalt etwacshsmr yfdtavsrpg rgeprfisvg yvddtqfvrf
 61 dsdaasprge prapwveqeg peywdretqn ykrqaqadrv slrnlrgyyn qsedgshtlq
121 rmygcdlgpd grlrgydqs aydgkdyial nedlrswtaa dtaaqitqrk leaaraaeql
181 raylegtcve wlrrylengk etlqraeppk thvthhplsd heatlrcwal gfypaeitlt
241 wqrdgedqtq dtelvetrpa gdgtfqkwaa vvvpsgqeqr ytchmqhegl qepltlswep
301 ssqptipimg ivaglavlvv lavlgavvta mmcrrkssgg kggscsqaac snsaggsdes
361 litcka
```

FIG. 7

```
NP_004039.1      msrsvalavlal-slsgleaiqrtpkiqvysrhpaengksnflncyvsgfhpsdievdll  60
NP_001009066.1   msrsvalavlal-slsgleaiqrtpkiqvysrhpaengksnflncyvsgfhpsdievdll  60
NP_001040602.1   msrsvalavlal-slsgleaiqrtpkiqvysrhppengkpnflncyvsgfhpsdievdll  60
NP_776318.1      marfvalvllgl-slsgldaiqrppkiqvysrhppedgkpnylncyvygfhppqieidll  60
NP_033865.2      marsvtlvflvlvsltglyaiqktpqiqvysrhppengkpn-lncyvtqfhpphieiqml  60
                 *:*.* *:*..  ::**.  :*:****::** ***.   *:  **.  *****  . :*

NP_004039.1      kngeriekvehsdlsfskdwsfyllyyteftptekdeyacrvnhvtlsqpkivkwdrdm  119  (SEQ ID NO:49)
NP_001009066.1   kngeriekvehsdlsfskdwsfyllyyteftptekdeyacrvnhvtlsqpkivkwdrdm  119  (SEQ ID NO:49)
NP_001040602.1   kngekmgkvehsdlsfskdwsfyllyyteftpnekdeyacrvnhvtlsgprtvkwdrdm  119  (SEQ ID NO:50)
NP_776318.1      kngekik-seqsdlsfskdwsfyllshaeftpnskdqyscrvkhvtleqprivkwdrdl  118  (SEQ ID NO:51)
NP_033865        kngkkipkvensdmsfskdwsfyilahteftptetdtyacrvkhasnaepktvywdrdm  119  (SEQ ID NO:52)
                 ***.:  ..*.:*:******:**.: :***. .:* *:***::.: .*: *: ****:
```

FIG. 8A

*HLA-A*

GSHSMRYFFTSVSRPGRGEPRFIAVGYVDDTQFVRFDSDAASQRMEPRAPWIEQE
GPEYWDGETRKVKAHSQTHRVDLGTLRGYYNQSEAGSHTVQRMYGCDVGSD
WRFLRGYHQYAYDGKDYIALKEDLRSWTAADMAAQTTKHKWEAAHVAEQLR
AYLEGTCVEWLRRYLENGKETLQRTDAPKTHMTHHAVSDHEATLRCWALSFYP
AEITLTWQRDGEDQTQDTELVETRPAGDGTFQKWAAVVVPSGQEQRYTCHVQH
EGLPKPLTLRWEP (SEQ ID NO:53)

FIG. 8B

*HLA-A (Y84A; A236C)*

GSHSMRYFFTSVSRPGRGEPRFIAVGYVDDTQFVRFDSDAASQRMEPRAPWIEQE
GPEYWDGETRKVKAHSQTHRVDLGTLRGAYNQSEAGSHTVQRMYGCDVGSD
WRFLRGYHQYAYDGKDYIALKEDLRSWTAADMAAQTTKHKWEAAHVAEQLR
AYLEGTCVEWLRRYLENGKETLQRTDAPKTHMTHHAVSDHEATLRCWALSFYP
AEITLTWQRDGEDQTQDTELVETRPCGDGTFQKWAAVVVPSGQEQRYTCHVQH
EGLPKPLTLRWEP (SEQ ID NO:225)

FIG. 8C

*HLA-A (Y84C; A139C)*

GSHSMRYFFTSVSRPGRGEPRFIAVGYVDDTQFVRFDSDAASQRMEPRAPWIEQE
GPEYWDGETRKVKAHSQTHRVDLGTLRGCYNQSEAGSHTVQRMYGCDVGSD
WRFLRGYHQYAYDGKDYIALKEDLRSWTAADMCAQTTKHKWEAAHVAEQLR
AYLEGTCVEWLRRYLENGKETLQRTDAPKTHMTHHAVSDHEATLRCWALSFYP
AEITLTWQRDGEDQTQDTELVETRPAGDGTFQKWAAVVVPSGQEQRYTCHVQH
EGLPKPLTLRWEP (SEQ ID NO:226)

FIG. 8D

HLA-A A11

GSHSMRYFYTSVSRPGRGEPRFIAVGYVDDTQFVRFDSDAASQRMEPRAPWIEQ
EGPEYWDQETRNVKAQSQTDRVDLGTLRGYYNQSEDGSHTIQIMYGCDVGPDG
RFLRGYRQDAYDGKDYIALNEDLRSWTAADMAAQITKRKWEAAHAAEQQRAY
LEGTCVEWLRRYLENGKETLQRTDPPKTHMTHHPISDHEATLRCWALGFYPAEI
TLTWQRDGEDQTQDTELVETRPAGDGTFQKWAAVVVPSGEEQRYTCHVQHEG
LPKPLTLRWE (SEQ ID NO:227)

FIG. 8E

HLA-A A11 (Y84A; A236C)

GSHSMRYFYTSVSRPGRGEPRFIAVGYVDDTQFVRFDSDAASQRMEPRAPWIEQ
EGPEYWDQETRNVKAQSQTDRVDLGTLRGAYNQSEDGSHTIQIMYGCDVGPDG
RFLRGYRQDAYDGKDYIALNEDLRSWTAADMAAQITKRKWEAAHAAEQQRAY
LEGTCVEWLRRYLENGKETLQRTDPPKTHMTHHPISDHEATLRCWALGFYPAEI
TLTWQRDGEDQTQDTELVETRPCGDGTFQKWAAVVVPSGEEQRYTCHVQHEG
LPKPLTLRWE (SEQ ID NO:228)

FIG. 8F

*HLA-B*

GSHSMRYFYTSVSRPGRGEPRFISVGYVDDTQFVRFDSDAASPREEPRAPWIEQE
GPEYWDRNTQIYKAQAQTDRESLRNLRGYYNQSEAGSHTLQSMYGCDVGPDGR
LLRGHDQYAYDGKDYIALNEDLRSWTAADTAAQITQRKWEAAREAEQRRAYLE
GECVEWLRRYLENGKDKLERADPPKTHVTHHPISDHEATLRCWALGFYPAEITL
TWQRDGEDQTQDTELVETRPAGDRTFQKWAAVVVPSGEEQRYTCHVQHEGLP
KPLTLRWEP (SEQ ID NO:229)

FIG. 8G
*HLA-B (Y84A; A236C)*

GSHSMRYFYTSVSRPGRGEPRFISVGYVDDTQFVRFDSDAASPREEPRAPWIEQE
GPEYWDRNTQIYKAQAQTDRESLRNLRG<u>A</u>YNQSEAGSHTLQSMYGCDVGPDGR
LLRGHDQYAYDGKDYIALNEDLRSWTAADTAAQITQRKWEAAREAEQRRAYLE
GECVEWLRRYLENGKDKLERADPPKTHVTHHPISDHEATLRCWALGFYPAEITL
TWQRDGEDQTQDTELVETRP<u>C</u>GDRTFQKWAAVVVPSGEEQRYTCHVQHEGLP
KPLTLRWEP (SEQ ID NO:230)

FIG. 8H
*HLA-B (Y84C; A139C)*

GSHSMRYFYTSVSRPGRGEPRFISVGYVDDTQFVRFDSDAASPREEPRAPWIEQE
GPEYWDRNTQIYKAQAQTDRESLRNLRG<u>C</u>YNQSEAGSHTLQSMYGCDVGPDGR
LLRGHDQYAYDGKDYIALNEDLRSWTAADT<u>C</u>AQITQRKWEAAREAEQRRAYLE
GECVEWLRRYLENGKDKLERADPPKTHVTHHPISDHEATLRCWALGFYPAEITL
TWQRDGEDQTQDTELVETRPAGDRTFQKWAAVVVPSGEEQRYTCHVQHEGLP
KPLTLRWEP (SEQ ID NO:231)

FIG. 8I

*HLA-C*

CSHSMRYFDTAVSRPGRGEPRFISVGYVDDTQFVRFDSDAASPRGEPRAPWVEQ
EGPEYWDRETQNYKRQAQADRVSLRNLRGYYNQSEDGSHTLQRMYGCDLGPD
GRLLRGYDQSAYDGKDYIALNEDLRSWTAADTAAQITQRKLEAARAAEQLRAY
LEGTCVEWLRRYLENGKETLQRAEPPKTHVTHHPLSDHEATLRCWALGFYPAEI
TLTWQRDGEDQTQDTELVETRPAGDGTFQKWAAVVVPSGQEQRYTCHMQHEG
LQEPLTLSWEP (SEQ ID NO:232)

FIG. 8J

*HLA-C (Y84A; A236C)*

CSHSMRYFDTAVSRPGRGEPRFISVGYVDDTQFVRFDSDAASPRGEPRAPWVEQ
EGPEYWDRETQNYKRQAQADRVSLRNLRG<u>A</u>YNQSEDGSHTLQRMYGCDLGPD
GRLLRGYDQSAYDGKDYIALNEDLRSWTAADTAAQITQRKLEAARAAEQLRAY
LEGTCVEWLRRYLENGKETLQRAEPPKTHVTHHPLSDHEATLRCWALGFYPAEI
TLTWQRDGEDQTQDTELVETRP<u>C</u>GDGTFQKWAAVVVPSGQEQRYTCHMQHEG
LQEPLTLSWEP (SEQ ID NO:233)

FIG. 8K

*HLA-C (Y84C; A139C)*

CSHSMRYFDTAVSRPGRGEPRFISVGYVDDTQFVRFDSDAASPRGEPRAPWVEQ
EGPEYWDRETQNYKRQAQADRVSLRNLRG<u>C</u>YNQSEDGSHTLQRMYGCDLGPD
GRLLRGYDQSAYDGKDYIALNEDLRSWTAADT<u>C</u>AQITQRKLEAARAAEQLRAY
LEGTCVEWLRRYLENGKETLQRAEPPKTHVTHHPLSDHEATLRCWALGFYPAEI
TLTWQRDGEDQTQDTELVETRPAGDGTFQKWAAVVVPSGQEQRYTCHMQHEG
LQEPLTLSWEP (SEQ ID NO:234)

<u>ATGTACAGGATGCAACTCCTGTCTTGCATTGCACTAAGTCTTGCACTTGTCACAAACAGT</u>*GGCTC*
*TCACTCCATGAGGTATTTCTTCACATCCGTGTCCCGGCCCGGCCGCGGGGAGCCCCGCTTCATCG*
*CAGTGGGCTACGTGGACGACACGCAGTTCGTGCGGTTCGACAGCGACGCCGCGAGCCAGAGGATG*
*GAGCCGCGGGCGCCGTGGATAGAGCAGGAGGGTCCGGAGTATTGGGACGGGGAGACACGGAAAGT*
*GAAGGCCCACTCACAGACTCACCGAGTGGACCTGGGGACCCTGCGCGGCGCCTACAACCAGAGCG*
*AGGCCGGTTCTCACACCGTCCAGAGGATGTATGGCTGCGACGTGGGGTCGGACTGGCGCTTCCTC*
*CGCGGGTACCACCAGTACGCCTACGACGGCAAGGATTACATCGCCCTGAAAGAGGACCTGCGCTC*
*TTGGACCGCGGCGGACATGGCAGCTCAGACCACCAAGCACAAGTGGGAGGCGGCCCATGTGGCGG*
*AGCAGTTGAGAGCCTACCTGGAGGGCACGTGCGTGGAGTGGCTCCGCAGATACCTGGAGAACGGG*
*AAGGAGACGCTGCAGCGCACGGACGCCCCCAAAACGCATATGACTCACCACGCTGTCTCTGACCA*
*TGAAGCCACCCTGAGGTGCTGGGCCCTGAGCTTCTACCCTGCGGAGATCACACTGACCTGGCAGC*
*GGGATGGGGAGGACCAGACCCAGGACACGGAGCTCGTGGAGACCAGGCCTTGCGGGGATGGAACC*
*TTCCAGAAGTGGGCGGCTGTGGTGGTGCCTTCTGGACAGGAGCAGAGATACACCTGCCATGTGCA*
*GCATGAGGGTTTGCCCAAGCCCCTCACCCTGAGATGGGAG*<u>GCAGCTGCGGGTGGC</u>GACAAAACTC
ACACATGCCCACCGTGCCCAGCACCTGAA<u>GCCGCC</u>GGGGGACCGTCAGTCTTCCTCTTCCCCCCA
AAACCCAAGGACACCCTCATGATCTCCCGGACCCCTGAGGTCACATGCGTGGTGGTGGACGTGAG
CCACGAAGACCCTGAGGTCAAGTTCAACTGGTACGTGGACGGCGTGGAGGTGCATAATGCCAAGA
CAAAGCCGCGGGAGGAGCAGTACAACAGCACGTACCGTGTGGTCAGCGTCCTCACCGTCCTGCAC
CAGGACTGGCTGAATGGCAAGGAGTACAAGTGCAAGGTCTCCAACAAAGCCCTCCCAGCCCCCAT
CGAGAAAACCATCTCCAAAGCCAAAGGGCAGCCCCGAGAACCACAGGTGTACACCCTGCCCCCAT
CCCGGGAGGAGATGACCAAGAACCAGGTCAGCCTGACCTGCCTGGTCAAAGGCTTCTATCCCAGC
GACATCGCCGTGGAGTGGGAGAGCAATGGGCAGCCGGAGAACAACTACAAGACCACGCCTCCCGT
GCTGGACTCCGACGGCTCCTTCTTCCTCTACAGCAAGCTCACCGTGGACAAGAGCAGATGGCAGC
AGGGGAACGTCTTCTCATGCTCCGTGATGCACGAGGCTCTGCACAACCACTACACGCAGAAGTCC
CTCTCCCTGTCTCCGGGTAAA<u>*TAGTGA*</u> (SEQ ID NO:244)

single underline    human IL2 leader sequence
Bold and italicized    human A0201 MHC Class I heavy chain
Double underlined    spacer
Bold    human IgG1 Fc, with LALA substitutions double underlined
Single underline and italicized    stop codons

*GSHSMRYFFTSVSRPGRGEPRFIAVGYVDDTQFVRFDSDAASQRMEPRAPWIEQEGPEYWDGETR
KVKAHSQTHRVDLGTLRGAYNQSEAGSHTVQRMYGCDVGSDWRFLRGYHQYAYDGKDYIALKEDL
RSWTAADMAAQTTKHKWEAAHVAEQLRAYLEGTCVEWLRRYLENGKETLQRTDAPKTHMTHHAVS
DHEATLRCWALSFYPAEITLTWQRDGEDQTQDTELVETRPCGDGTFQKWAAVVVPSGQEQRYTCH
VQHEGLPKPLTLRWE*<u>AAAGG</u>DKTHTCPPCPAPE<u>AA</u>**GGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK** (SEQ ID
NO:245)

Bold and italicized    human A0201 MHC Class I heavy chain
Double underlined    spacer
Bold    human IgG1 Fc, with LALA substitutions double underlined

<u>ATGTATCGCATGCAACTGCTGAGCTGCATTGCACTCTCTCTGGCACTCGTCACCAATTCC</u>*GGCTC*
*TCACTCCATGAGGTATTTCTTCACATCCGTGTCCCGGCCCGGCCGCGGGGAGCCCCGCTTCATCG*
*CAGTGGGCTACGTGGACGACACGCAGTTCGTGCGGTTCGACAGCGACGCCGCGAGCCAGAGGATG*
*GAGCCGCGGGCGCCGTGGATAGAGCAGGAGGGTCCGGAGTATTGGGACGGGGAGACACGGAAAGT*
***GAAGGCCCACTCACAGACTCACCGAGTGGACCTGGGGACCCTGCGCGGC*<u>TGC</u>*TACAACCAGAGCG***
*AGGCCGGTTCTCACACCGTCCAGAGGATGTATGGCTGCGACGTGGGGTCGGACTGGCGCTTCCTC*
*CGCGGGTACCACCAGTACGCCTACGACGGCAAGGATTACATCGCCCTGAAAGAGGACCTGCGCTC*
*TTGGACCGCGGCGGACATGGCAGCTCAGACCACCAAGCACAAGTGGGAGGCGGCCCATGTGGCGG*
*AGCAGTTGAGAGCCTACCTGGAGGGCACGTGCGTGGAGTGGCTCCGCAGATACCTGGAGAACGGG*
*AAGGAGACGCTGCAGCGCACGGACGCCCCAAAACGCATATGACTCACCACGCTGTCTCTGACCA*
*TGAAGCCACCCTGAGGTGCTGGGCCCTGAGCTTCTACCCTGCGGAGATCACACTGACCTGGCAGC*
*GGGATGGGGAGGACCAGACCCAGGACACGGAGCTCGTGGAGACCAGGCCTTGCGGGGATGGAACC*
*TTCCAGAAGTGGGCGGCTGTGGTGGTGCCTTCTGGACAGGAGCAGAGATACACCTGCCATGTGCA*
*GCATGAGGGTTTGCCCAAGCCCCTCACCCTGAGATGGGAG*<u>GCAGCTGCGGGTGGC</u>GACAAAACTC
ACACATGCCCACCGTGCCCAGCACCTGAA<u>GCCGCC</u>GGGGGACCGTCAGTCTTCCTCTTCCCCCA
AAACCCAAGGACACCCTCATGATCTCCCGGACCCCTGAGGTCACATGCGTGGTGGTGGACGTGAG
CCACGAAGACCCTGAGGTCAAGTTCAACTGGTACGTGGACGGCGTGGAGGTGCATAATGCCAAGA
CAAAGCCGCGGGAGGAGCAGTACAACAGCACGTACCGTGTGGTCAGCGTCCTCACCGTCCTGCAC
CAGGACTGGCTGAATGGCAAGGAGTACAAGTGCAAGGTCTCCAACAAAGCCCTCCCAGCCCCCAT
CGAGAAAACCATCTCCAAAGCCAAAGGGCAGCCCCGAGAACCACAGGTGTACACCCTGCCCCCAT
CCCGGGAGGAGATGACCAAGAACCAGGTCAGCCTGACCTGCCTGGTCAAAGGCTTCTATCCCAGC
GACATCGCCGTGGAGTGGGAGAGCAATGGGCAGCCGGAGAACAACTACAAGACCACGCCTCCCGT
GCTGGACTCCGACGGCTCCTTCTTCCTCTACAGCAAGCTCACCGTGGACAAGAGCAGATGGCAGC
AGGGGAACGTCTTCTCATGCTCCGTGATGCACGAGGCTCTGCACAACCACTACACGCAGAAGTCC
CTCTCCCTGTCTCCGGGTAAA<u>*TAGTGA*</u> (SEQ ID NO:246)

single underline    human IL2 leader sequence
Bold and italicized    human A0201 MHC Class I heavy chain; with Y84C double underlined
Double underlined    spacer
Bold    human IgG1 Fc, with LALA substitutions double underlined
Single underline and italicized    stop codons

*GSHSMRYFFTSVSRPGRGEPRFIAVGYVDDTQFVRFDSDAASQRMEPRAPWIEQEGPEYWDGETR*
*KVKAHSQTHRVDLGTLRGCYNQSEAGSHTVQRMYGCDVGSDWRFLRGYHQYAYDGKDYIALKEDL*
*RSWTAADMAAQTTKHKWEAAHVAEQLRAYLEGTCVEWLRRYLENGKETLQRTDAPKTHMTHHAVS*
*DHEATLRCWALSFYPAEITLTWQRDGEDQTQDTELVETRPCGDGTFQKWAAVVVPSGQEQRYTCH*
*VQHEGLPKPLTLRWE*AAAGGDKTHTCPPCPAPEAAGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK (SEQ ID
NO:247)

Bold and italicized    human A0201 MHC Class I heavy chain; with Y84C double underlined
Double underlined    spacer
Bold    human IgG1 Fc, with LALA substitutions double underlined

FIG. 12A

1938 atgtctcgctccgtggccttagctgtgctcgcgctactctctctttctggcctggaggccTTCCTGCCCTCCGACTTCTTC CCCTCCGTGGGTGGAGGTGGTTCTGGAGGAGGCGGTTCGGGCGGAGGTGGTAGTAT CCAGCGTACTCCAAAGATTCAGGTTTACTCATGCCATCCAGCAGAGAATGGAAA GTCAAATTTCCTGAATTGCTATGTGTCTGGGTTTCATCCATCCGACATTGAAGTT GACTTACTGAAGAATGGAGAGAGAATTGAAAAAGTGGAGCATTCAGACTTGTCT TTCAGCAAGGACTGGTCTTTCTATCTCTTGTATTATACTGAATTCACCCCCACTG AAAAAGATGAGTATGCCTGCCGTGTGAACCACGTGACTTTGTCACAGCCCAAGA TAGTTAAGTGGGATCGAGACATGTAGTGA (SEQ ID NO:248)

lower case   β2M leader
bold and underlined   HBV (C18-27) epitope
double underlined   (G4S)3
bold   human β2M
single underlined   stop codons

FLPSDFFPSVGGGGSGGGGSGGGGSIQRTPKIQVYSCHPAENGKSNFLNCYVSGFHPSDIEVDLL KNGERIEKVEHSDLSFSKDWSFYLLYYTEFTPTEKDEYACRVNHVTLSQPKIVKWDRDM (SEQ ID NO:249)

bold and underlined   HBV (C18-27) epitope
double underlined   (G4S)3
bold   human β2M

ATGTCTCGCTCCGTGGCCTTAGCTGTGCTCGCGCTACTCTCTCTTTCTGGCCTGGAGGCCTTCCT GCCCTCCGACTTCTTCCCCTCCGTGGGT*TGC*GGTGGTTCTGGAGGAGGCGGTTCGGGCGGAGGTG GTAGTATCCAGCGTACTCCAAAGATTCAGGTTTACTCATGCCATCCAGCAGAGAATGGAAAGTCA AATTTCCTGAATTGCTATGTGTCTGGGTTTCATCCATCCGACATTGAAGTTGACTTACTGAAGAA TGGAGAGAGAATTGAAAAAGTGGAGCATTCAGACTTGTCTTTCAGCAAGGACTGGTCTTTCTATC TCTTGTATTATACTGAATTCACCCCCACTGAAAAAGATGAGTATGCCTGCCGTGTGAACCACGTG ACTTTGTCACAGCCCAAGATAGTTAAGTGGGATCGAGACATG*TAGTGA* (SEQ ID NO:250)

Single underline   β2M leader
bold and underlined   HBV (C18-27) epitope
double underlined   linker (G4S)3 with Gly-to-Cys substitution at second Gly (bold and italiced)
bold   human β2M
single underlined and italicized   stop codons

FIG. 12D
2452

FLPSDFFPSVG*C*GGSGGGGSGGGGS**IQRTPKIQVYSCHPAENGKSNFLNCYVSGFHPS
DIEVDLLKNGERIEKVEHSDLSFSKDWSFYLLYYTEFTPTEKDEYACRVNHVTLSQP
KIVKWDRDM** (SEQ ID NO:251)

bold and underlined    HBV (C18-27) epitope
double underlined    linker (G4S)3 with Gly-to-Cys substitution at second Gly (bold and italicized)
bold    human β2M

FIG. 13A
1380

<u>ATGTATCGCATGCAACTGCTGAGCTGCATTGCACTCTCTCTGGCACTCGTCACCAATTCC</u>*GCCCC*
*TACTTCCAGCTCCACCAAGAAGACGCAGCTTCAGCTGGAAGCACTGCTGCTCGATCTGCAGATGA*
*TACTGAATGGCATTAACAACTACAAAAACCCCAAGCTCACTCGCATGCTGACCGCTAAATTCTAC*
*ATGCCCAAGAAGGCTACGGAACTGAAGCACCTGCAGTGCCTTGAGGAGGAACTCAAGCCACTCGA*
*GGAGGTGCTGAACCTGGCACAGTCAAAGAACTTTCACCTGCGGCCAAGAGACCTGATTTCAACA*
*TCAACGTGATTGTGCTGGAATTGAAGGGCTCAGAAACTACGTTCATGTGCGAGTACGCCGACGAA*
*ACTGCTACTATCGTGGAGTTCTTGAACCGCTGGATCACGTTCTGCCAGAGCATTATTTCAACTCT*
*TACC*<u>GGTGGAGGTGGTTCTGGAGGTGGTGGATCAGGAGGAGGTGGCTCCGGGGGTGGAGGTAGC</u>G
CTCCCACGTCATCCTCCACTAAAAAGACCCAGCTGCAACTCGAGGCACTGTTGCTGGACCTCCAG
ATGATTCTGAACGGAATCAACAACTATAAGAACCCGAAGCTGACTAGAATGTTGACTGCCAAATT
TTATATGCCAAAGAAGGCAACTGAGTTGAAGCATCTGCAATGCCTGGAAGAGGAGCTGAAGCCAC
TGGAAGAGGTGCTTAACCTCGCTCAGTCCAAGAACTTCCATCTGCGCCCACGGGACCTTATCTCC
AACATTAACGTGATCGTGCTGGAACTGAAGGGATCCGAAACCACTTTTATGTGCGAATACGCTGA
CGAAACCGCCACTATCGTCGAGTTCCTGAACAGGTGGATCACCTTCTGCCAGTCCATTATCTCCA
CCCTCACCGGAGGAGGAGGATCCGGTGGTGGAGGCTCGGGTGGAGGAGGCTCAGGAGGAGGCGGA
AGCGGCTCTCACTCCATGAGGTATTTCTTCACATCCGTGTCCCGGCCCGGCCGCGGGGAGCCCCG
CTTCATCGCAGTGGGCTACGTGGACGACACGCAGTTCGTGCGGTTCGACAGCGACGCCGCGAGCC
AGAGGATGGAGCCGCGGGCGCCGTGGATAGAGCAGGAGGGTCCGGAGTATTGGGACGGGGAGACA
CGGAAAGTGAAGGCCCACTCACAGACTCACCGAGTGGACCTGGGGACCCTGCGCGGCGCCTACAA
CCAGAGCGAGGCCGGTTCTCACACCGTCCAGAGGATGTATGGCTGCGACGTGGGGTCGGACTGGC
GCTTCCTCCGCGGGTACCACCAGTACGCCTACGACGGCAAGGATTACATCGCCCTGAAAGAGGAC
CTGCGCTCTTGGACCGCGGCGGACATGGCAGCTCAGACCACCAAGCACAAGTGGGAGGCGGCCCA
TGTGGCGGAGCAGTTGAGAGCCTACCTGGAGGGCACGTGCGTGGAGTGGCTCCGCAGATACCTGG
AGAACGGGAAGGAGACGCTGCAGCGCACGGACGCCCCCAAAACGCATATGACTCACCACGCTGTC
TCTGACCATGAAGCCACCCTGAGGTGCTGGGCCCTGAGCTTCTACCCTGCGGAGATCACACTGAC
CTGGCAGCGGGATGGGGAGGACCAGACCCAGGACACGGAGCTCGTGGAGACCAGGCCTTGCGGGG
ATGGAACCTTCCAGAAGTGGGCGGCTGTGGTGGTGCCTTCTGGACAGGAGCAGAGATACACCTGC
CATGTGCAGCATGAGGGTTTGCCCAAGCCCCTCACCCTGAGATGGGAGGCAGCTGCGGGTGGC<u>GA</u>
<u>CAAAACTCACACATGCCCACCGTGCCCAGCACCTGAAGCCGCCGGGGACCGTCAGTCTTCCTCT</u>
<u>TCCCCCCAAAACCCAAGGACACCCTCATGATCTCCCGGACCCCTGAGGTCACATGCGTGGTGGTG</u>
<u>GACGTGAGCCACGAAGACCCTGAGGTCAAGTTCAACTGGTACGTGGACGGCGTGGAGGTGCATAA</u>
<u>TGCCAAGACAAAGCCGCGGGAGGAGCAGTACAACAGCACGTACCGTGTGGTCAGCGTCCTCACCG</u>
<u>TCCTGCACCAGGACTGGCTGAATGGCAAGGAGTACAAGTGCAAGGTCTCCAACAAAGCCCTCCCA</u>
<u>GCCCCCATCGAGAAAACCATCTCCAAAGCCAAAGGGCAGCCCCGAGAACCACAGGTGTACACCCT</u>
<u>GCCCCCATCCCGGGAGGAGATGACCAAGAACCAGGTCAGCCTGACCTGCCTGGTCAAAGGCTTCT</u>
<u>ATCCCAGCGACATCGCCGTGGAGTGGGAGAGCAATGGGCAGCCGGAGAACAACTACAAGACCACG</u>
<u>CCTCCCGTGCTGGACTCCGACGGCTCCTTCTTCCTCTACAGCAAGCTCACCGTGGACAAGAGCAG</u>
<u>ATGGCAGCAGGGGAACGTCTTCTCATGCTCCGTGATGCACGAGGCTCTGCACAACCACTACACGC</u>
<u>AGAAGTCCCTCTCCCTGTCTCCGGGTAAA</u><u>TAGTGA</u> (SEQ ID NO:252)

Single underline   human IL2 signal
Bold and italicized   human IL2 (H16A; F42A)
Double underlined   (G4S)4
Bold   human A0201 MHC Class I H chain
Bold and double underlined   AAAGG spacer coding
Italicized   human IgG1 Fc (LALA)

Single underline and italicized  stop codons

***APTSSSTKKTQLQLEALLLDLQMILNGINNYKNPKLTRMLTAKFYMPKKATELKHLQCL
EEELKPLEEVLNLAQSKNFHLRPRDLISNINVIVLELKGSETTFMCEYADETATIVEFL
NRWITFCQSIISTLT* <u>GGGGSGGGGSGGGGSGGGGS</u>*APTSSSTKKTQLQLEALLLDLQMI
LNGINNYKNPKLTRMLTAKFYMPKKATELKHLQCLEEELKPLEEVLNLAQSKNFHLRPR
DLISNINVIVLELKGSETTFMCEYADETATIVEFLNRWITFCQSIISTLT*** <u>GGGGSGGGG
SGGGGSGGGGSGS</u>**HSMRYFFTSVSRPGRGEPRFIAVGYVDDTQFVRFDSDAASQRMEPR
APWIEQEGPEYWDGETRKVKAHSQTHRVDLGTLRGAYNQSEAGSHTVQRMYGCDVGSDW
RFLRGYHQYAYDGKDYIALKEDLRSWTAADMAAQTTKHKWEAAHVAEQLRAYLEGTCVE
WLRRYLENGKETLQRTDAPKTHMTHHAVSDHEATLRCWALSFYPAEITLTWQRDGEDQT
QDTELVETRPCGDGTFQKWAAVVVPSGQEQRYTCHVQHEGLPKPLTLRWE<u>AAAGG**</u>*DKTH
TCPPCPAPEAAGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK* (SEQ ID
NO:253)

Bold and italicized  human IL2 (H16A; F42A)
Double underlined  (G4S)4
Bold  human A0201 MHC Class I H chain
Bold and double underlined  AAAGG spacer
Italicized  human IgG1 Fc (LALA)

FIG. 13C
1715

<u>ATGTATCGCATGCAACTGCTGAGCTGCATTGCACTCTCTCTGGCACTCGTCACCAATTCC</u>*GCCCC*
*TACTTCCAGCTCCACCAAGAAGACGCAGCTTCAGCTGGAAGCACTGCTGCTCGATCTGCAGATGA*
*TACTGAATGGCATTAACAACTACAAAAACCCCAAGCTCACTCGCATGCTGACCGCTAAATTCTAC*
*ATGCCCAAGAAGGCTACGGAACTGAAGCACCTGCAGTGCCTTGAGGAGGAACTCAAGCCACTCGA*
*GGAGGTGCTGAACCTGGCACAGTCAAAGAACTTTCACCTGCGGCCAAGAGACCTGATTTCAACA*
*TCAACGTGATTGTGCTGGAATTGAAGGGCTCAGAAACTACGTTCATGTGCGAGTACGCCGACGAA*
*ACTGCTACTATCGTGGAGTTCTTGAACCGCTGGATCACGTTCTGCCAGAGCATTATTTCAACTCT*
*TACC*<u>GGTGGAGGTGGTTCTGGAGGTGGTGGATCAGGAGGAGGTGGCTCCGGGGGTGGAGGTAGC</u>G
CTCCCACGTCATCCTCCACTAAAAAGACCCAGCTGCAACTCGAGGCACTGTTGCTGGACCTCCAG
ATGATTCTGAACGGAATCAACAACTATAAGAACCCGAAGCTGACTAGAATGTTGACTGCCAAATT
TTATATGCCAAAGAAGGCAACTGAGTTGAAGCATCTGCAATGCCTGGAAGAGGAGCTGAAGCCAC
TGGAAGAGGTGCTTAACCTCGCTCAGTCCAAGAACTTCCATCTGCGCCCACGGGACCTTATCTCC
AACATTAACGTGATCGTGCTGGAACTGAAGGGATCCGAAACCACTTTTATGTGCGAATACGCTGA
CGAAACCGCCACTATCGTCGAGTTCCTGAACAGGTGGATCACCTTCTGCCAGTCCATTATCTCCA
CCCTCACC<u>GGAGGAGGAGGATCCGGTGGTGGAGGCTCGGGTGGAGGAGGCTCAGGAGGAGGCGGA</u>
<u>AGC</u>GGCTCTCACTCCATGAGGTATTTCTTCACATCCGTGTCCCGGCCCGGCCGCGGGGAGCCCCG
CTTCATCGCAGTGGGCTACGTGGACGACACGCAGTTCGTGCGGTTCGACAGCGACGCCGCGAGCC
AGAGGATGGAGCCGCGGGCGCCGTGGATAGAGCAGGAGGGTCCGGAGTATTGGGACGGGGAGACA
CGGAAAGTGAAGGCCCACTCACAGACTCACCGAGTGGACCTGGGGACCCTGCGCGGC<u>TGC</u>TACAA
CCAGAGCGAGGCCGGTTCTCACACCGTCCAGAGGATGTATGGCTGCGACGTGGGGTCGGACTGGC
GCTTCCTCCGCGGGTACCACCAGTACGCCTACGACGGCAAGGATTACATCGCCCTGAAAGAGGAC
CTGCGCTCTTGGACCGCGGCGGACATGGCAGCTCAGACCACCAAGCACAAGTGGGAGGCGGCCCA
TGTGGCGGAGCAGTTGAGAGCCTACCTGGAGGGCACGTGCGTGGAGTGGCTCCGCAGATACCTGG
AGAACGGGAAGGAGACGCTGCAGCGCACGGACGCCCCCAAAACGCATATGACTCACCACGCTGTC
TCTGACCATGAAGCCACCCTGAGGTGCTGGGCCCTGAGCTTCTACCCTGCGGAGATCACACTGAC
CTGGCAGCGGGATGGGGAGGACCAGACCCAGGACACGGAGCTCGTGGAGACCAGGCCTTGCGGGG
ATGGAACCTTCCAGAAGTGGGCGGCTGTGGTGGTGCCTTCTGGACAGGAGCAGAGATACACCTGC
CATGTGCAGCATGAGGGTTTGCCCAAGCCCCTCACCCTGAGATGGGAG<u>GCAGCTGCGGGTGGC</u>*GA*
*CAAAACTCACACATGCCCACCGTGCCCAGCACCTGAAGCCGCCGGGGACCGTCAGTCTTCCTCT*
*TCCCCCCAAAACCCAAGGACACCCTCATGATCTCCCGGACCCCTGAGGTCACATGCGTGGTGGTG*
*GACGTGAGCCACGAAGACCCTGAGGTCAAGTTCAACTGGTACGTGGACGGCGTGGAGGTGCATAA*
*TGCCAAGACAAAGCCGCGGGAGGAGCAGTACAACAGCACGTACCGTGTGGTCAGCGTCCTCACCG*
*TCCTGCACCAGGACTGGCTGAATGGCAAGGAGTACAAGTGCAAGGTCTCCAACAAAGCCCTCCCA*
*GCCCCCATCGAGAAAACCATCTCCAAAGCCAAAGGGCAGCCCCGAGAACCACAGGTGTACACCCT*
*GCCCCCATCCCGGGAGGAGATGACCAAGAACCAGGTCAGCCTGACCTGCCTGGTCAAAGGCTTCT*
*ATCCCAGCGACATCGCCGTGGAGTGGGAGAGCAATGGGCAGCCGGAGAACAACTACAAGACCACG*
*CCTCCCGTGCTGGACTCCGACGGCTCCTTCTTCCTCTACAGCAAGCTCACCGTGGACAAGAGCAG*
*ATGGCAGCAGGGGAACGTCTTCTCATGCTCCGTGATGCACGAGGCTCTGCACAACCACTACACGC*
*AGAAGTCCCTCTCCCTGTCTCCGGGTAAA*<u>TAGTGA</u> (SEQ ID NO:254)

Single underline    human IL2 signal
Bold and italicized    human IL2 (H16A; F42A)
Double underlined    (G4S)4
Bold    human A0201 MHC Class I H chain, with Y84C double underlined
Bold and double underlined    AAAGG spacer coding
Italicized    human IgG1 Fc (LALA)

Single underline and italicized   stop codons

FIG. 13D
<u>1715</u>

***APTSSSTKKTQLQLEALLLDLQMILNGINNYKNPKLTRMLTAKFYMPKKATELKHLQCL
EEELKPLEEVLNLAQSKNFHLRPRDLISNINVIVLELKGSETTFMCEYADETATIVEFL
NRWITFCQSIISTLT* <u>GGGGSGGGGSGGGGSGGGGS</u>*APTSSSTKKTQLQLEALLLDLQMI
LNGINNYKNPKLTRMLTAKFYMPKKATELKHLQCLEEELKPLEEVLNLAQSKNFHLRPR
DLISNINVIVLELKGSETTFMCEYADETATIVEFLNRWITFCQSIISTLT*** <u>GGGGSGGGG
SGGGGSGGGGSGS</u>**HSMRYFFTSVSRPGRGEPRFIAVGYVDDTQFVRFDSDAASQRMEPR
APWIEQEGPEYWDGETRKVKAHSQTHRVDLGTLRG<u>C</u>YNQSEAGSHTVQRMYGCDVGSDW
RFLRGYHQYAYDGKDYIALKEDLRSWTAADMAAQTTKHKWEAAHVAEQLRAYLEGTCVE
WLRRYLENGKETLQRTDAPKTHMTHHAVSDHEATLRCWALSFYPAEITLTWQRDGEDQT
QDTELVETRPCGDTFQKWAAVVVPSGQEQRYTCHVQHEGLPKPLTLRWE<u>AAAGG**</u>*DKTH
TCPPCPAPEAAGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK* (SEQ ID
NO:255)

Bold and italicized   human IL2 (H16A; F42A)
Double underlined   (G4S)4
Bold   human A0201 MHC Class I H chain, with Y84C double underlined
Bold and double underlined   AAAGG spacer
Italicized   human IgG1 Fc (LALA)

FIG. 14A
2316

<u>ATGTATCGCATGCAACTGCTGAGCTGCATTGCACTCTCTCTGGCACTCGTCACCAATTCC</u>*GTTAT*
*CCACGTGACCAAGGAAGTGAAAGAAGTGGCAACGCTGTCCTGTGGTCACAATGTTTCTGTTGAAG*
*AGCTGGCACAAACTCGCATCTACTGGCAAAAGGAGAAGAAAATGGTGCTGACTATGATGTCTGGG*
*GACATGAATATATGGCCCGAGTACAAGAACCGGACCATCTTTGATATCACTAATAACCTCTCCAT*
*TGTGATCCTGGCTCTGCGCCCATCTGACGAGGGCACATACGAGTGTGTTGTTCTGGCCTATGAAA*
*AAGACGCTTTCAAGCGGGAACACCTGGCTGAAGTGACGTTATCAGTCAAAGCTGACTTCCCTACA*
*CCTAGTATATCTGACTTTGAAATTCCAACTTCTAATATTAGAAGGATAATTTGCTCAACCTCTGG*
*AGGTTTTCCAGAGCCTCACCTCTCCTGGTTGGAAAATGGAGAAGAATTAAATGCCATCAACACAA*
*CAGTTTCCCAAGATCCTGAAACTGAGCTCTATGCTGTTAGCAGCAAACTGGATTTCAATATGACA*
*ACCAACCACAGCTTCATGTGTCTCATCAAGTATGGACATTTAAGAGTGAATCAGACCTTCAACTG*
*GAATACAACCAAGCAAGAGCATTTTCCTGATAAC*<u>GGAGGAGGAGGATCCGGTGGTGGAGGCTCGG</u>
<u>GTGGAGGAGGCTCAGGAGGAGGCGGAAGC</u>GGCTCTCACTCCATGAGGTATTTCTTCACATCCGTG
TCCCGGCCCGGCCGCGGGGAGCCCCGCTTCATCGCAGTGGGCTACGTGGACGACACGCAGTTCGT
GCGGTTCGACAGCGACGCCGCGAGCCAGAGGATGGAGCCGCGGGCGCCGTGGATAGAGCAGGAGG
GTCCGGAGTATTGGGACGGGGAGACACGGAAAGTGAAGGCCCACTCACAGACTCACCGAGTGGAC
CTGGGGACCCTGCGCGGCGCCTACAACCAGAGCGAGGCCGGTTCTCACACCGTCCAGAGGATGTA
TGGCTGCGACGTGGGGTCGGACTGGCGCTTCCTCCGCGGGTACCACCAGTACGCCTACGACGGCA
AGGATTACATCGCCCTGAAAGAGGACCTGCGCTCTTGGACCGCGGCGGACATGGCAGCTCAGACC
ACCAAGCACAAGTGGGAGGCGGCCCATGTGGCGGAGCAGTTGAGAGCCTACCTGGAGGGCACGTG
CGTGGAGTGGCTCCGCAGATACCTGGAGAACGGGAAGGAGACGCTGCAGCGCACGGACGCCCCCA
AAACGCATATGACTCACCACGCTGTCTCTGACCATGAAGCCACCCTGAGGTGCTGGGCCCTGAGC
TTCTACCCTGCGGAGATCACACTGACCTGGCAGCGGGATGGGGAGGACCAGACCCAGGACACGGA
GCTCGTGGAGACCAGGCCTTGCGGGGATGGAACCTTCCAGAAGTGGGCGGCTGTGGTGGTGCCTT
CTGGACAGGAGCAGAGATACACCTGCCATGTGCAGCATGAGGGTTTGCCCAAGCCCCTCACCCTG
AGATGGAGG<u>CAGCTGCGGGTGGC</u>*GACAAAACTCACACATGCCCACCGTGCCCAGCACCTGAAGC*
*CGCCGGGGGACCGTCAGTCTTCCTCTTCCCCCCAAAACCCAAGGACACCCTCATGATCTCCCGGA*
*CCCCTGAGGTCACATGCGTGGTGGTGGACGTGAGCCACGAAGACCCTGAGGTCAAGTTCAACTGG*
*TACGTGGACGGCGTGGAGGTGCATAATGCCAAGACAAAGCCGCGGGAGGAGCAGTACAACAGCAC*
*GTACCGTGTGGTCAGCGTCCTCACCGTCCTGCACCAGGACTGGCTGAATGGCAAGGAGTACAAGT*
*GCAAGGTCTCCAACAAAGCCCTCCCAGCCCCCATCGAGAAAACCATCTCCAAAGCCAAAGGGCAG*
*CCCCGAGAACCACAGGTGTACACCCTGCCCCCATCCCGGGAGGAGATGACCAAGAACCAGGTCAG*
*CCTGACCTGCCTGGTCAAAGGCTTCTATCCCAGCGACATCGCCGTGGAGTGGGAGAGCAATGGGC*
*AGCCGGAGAACAACTACAAGACCACGCCTCCCGTGCTGGACTCCGACGGCTCCTTCTTCCTCTAC*
*AGCAAGCTCACCGTGGACAAGAGCAGATGGCAGCAGGGGAACGTCTTCTCATGCTCCGTGATGCA*
*CGAGGCTCTGCACAACCACTACACGCAGAAGTCCCTCTCCCTGTCTCCGGGTAAA*<u>*TAGTGA*</u>
(SEQ ID NO:256)

Single underline    human IL2 signal
Bold and italicized    CD80 (K86A)
Double underlined    (G4S)4
Bold    human A0201 MHC Class I H chain
Bold and double underlined    AAAGG spacer coding
Italicized    human IgG1 Fc (LALA)
Single underlined and italicized    stop codons

FIG. 14B
2316

**VIHVTKEVKEVATLSCGHNVSVEELAQTRIYWQKEKKMVLTMMSGDMNIWPEYKNRTIF
DITNNLSIVILALRPSDEGTYECVVLAYEKDAFKREHLAEVTLSVKADFPTPSISDFEI
PTSNIRRIICSTSGGFPEPHLSWLENGEELNAINTTVSQDPETELYAVSSKLDFNMTTN
HSFMCLIKYGHLRVNQTFNWNTTKQEHFPDN<u>GGGGSGGGGSGGGGSGGGGSGS</u>HSMRYF
FTSVSRPGRGEPRFIAVGYVDDTQFVRFDSDAASQRMEPRAPWIEQEGPEYWDGETRKV
KAHSQTHRVDLGTLRGAYNQSEAGSHTVQRMYGCDVGSDWRFLRGYHQYAYDGKDYIAL
KEDLRSWTAADMAAQTTKHKWEAAHVAEQLRAYLEGTCVEWLRRYLENGKETLQRTDAP
KTHMTHHAVSDHEATLRCWALSFYPAEITLTWQRDGEDQTQDTELVETRPCGDGTFQKW
AAVVVPSGQEQRYTCHVQHEGLPKPLTLRWE<u>AAAGG**</u>*DKTHTCPPCPAPEAAGGPSVFLF
PPKPKDTLMISRTPEVTCVVVDVSHEDPEVKFNWYVDGVEVHNAKTKPREEQYNSTYRV
VSVLTVLHQDWLNGKEYKCKVSNKALPAPIEKTISKAKGQPREPQVYTLPPSREEMTKN
QVSLTCLVKGFYPSDIAVEWESNGQPENNYKTTPPVLDSDGSFFLYSKLTVDKSRWQQG
NVFSCSVMHEALHNHYTQKSLSLSPGK* (SEQ ID NO:257)

Bold and italicized    CD80 (K86A)
Double underlined    (G4S)4
Bold    human A0201 MHC Class I H chain
Bold and double underlined    AAAGG spacer
Italicized    human IgG1 Fc (LALA)

ATGTATCGCATGCAACTGCTGAGCTGCATTGCACTCTCTCTGGCACTCGTCACCAATTCC*GTTAT*
*CCACGTGACCAAGGAAGTGAAAGAAGTGGCAACGCTGTCCTGTGGTCACAATGTTTCTGTTGAAG*
*AGCTGGCACAAACTCGCATCTACTGGCAAAAGGAGAAGAAAATGGTGCTGACTATGATGTCTGGG*
*GACATGAATATATGGCCCGAGTACAAGAACCGGACCATCTTTGATATCACTAATAACCTCTCCAT*
*TGTGATCCTGGCTCTGCGCCCATCTGACGAGGGCACATACGAGTGTGTTGTTCTGGCCTATGAAA*
*AAGACGCTTTCAAGCGGGAACACCTGGCTGAAGTGACGTTATCAGTCAAAGCTGACTTCCCTACA*
*CCTAGTATATCTGACTTTGAAATTCCAACTTCTAATATTAGAAGGATAATTTGCTCAACCTCTGG*
*AGGTTTTCCAGAGCCTCACCTCTCCTGGTTGGAAAATGGAGAAGAATTAAATGCCATCAACACAA*
*CAGTTTCCCAAGATCCTGAAACTGAGCTCTATGCTGTTAGCAGCAAACTGGATTTCAATATGACA*
*ACCAACCACAGCTTCATGTGTCTCATCAAGTATGGACATTTAAGAGTGAATCAGACCTTCAACTG*
*GAATACAACCAAGCAAGAGCATTTTCCTGATAAC*<u>GGAGGAGGAGGATCCGGTGGTGGAGGCTCGG</u>
<u>GTGGAGGAGGCTCAGGAGGAGGCGGAAGC</u>GGCTCTCACTCCATGAGGTATTTCTTCACATCCGTG
TCCCGGCCCGGCCGCGGGGAGCCCCGCTTCATCGCAGTGGGCTACGTGGACGACACGCAGTTCGT
GCGGTTCGACAGCGACGCCGCGAGCCAGAGGATGGAGCCGCGGGCGCCGTGGATAGAGCAGGAGG
GTCCGGAGTATTGGGACGGGGAGACACGGAAAGTGAAGGCCCACTCACAGACTCACCGAGTGGAC
CTGGGGACCCTGCGCGGC<u>TGC</u>TACAACCAGAGCGAGGCCGGTTCTCACACCGTCCAGAGGATGTA
TGGCTGCGACGTGGGGTCGGACTGGCGCTTCCTCCGCGGGTACCACCAGTACGCCTACGACGGCA
AGGATTACATCGCCCTGAAAGAGGACCTGCGCTCTTGGACCGCGGCGGACATGGCAGCTCAGACC
ACCAAGCACAAGTGGGAGGCGGCCCATGTGGCGGAGCAGTTGAGAGCCTACCTGGAGGGCACGTG
CGTGGAGTGGCTCCGCAGATACCTGGAGAACGGGAAGGAGACGCTGCAGCGCACGGACGCCCCCA
AAACGCATATGACTCACCACGCTGTCTCTGACCATGAAGCCACCCTGAGGTGCTGGGCCCTGAGC
TTCTACCCTGCGGAGATCACACTGACCTGGCAGCGGGATGGGGAGGACCAGACCCAGGACACGGA
GCTCGTGGAGACCAGGCCTTGCGGGGATGGAACCTTCCAGAAGTGGGCGGCTGTGGTGGTGCCTT
CTGGACAGGAGCAGAGATACACCTGCCATGTGCAGCATGAGGGTTTGCCCAAGCCCCTCACCCTG
AGATGGAG<u>GCAGCTGCGGGTGGC</u>*GACAAAACTCACACATGCCCACCGTGCCCAGCACCTGAAGC*
*CGCCGGGGGACCGTCAGTCTTCCTCTTCCCCCCAAAACCCAAGGACACCCTCATGATCTCCCGGA*
*CCCCTGAGGTCACATGCGTGGTGGTGGACGTGAGCCACGAAGACCCTGAGGTCAAGTTCAACTGG*
*TACGTGGACGGCGTGGAGGTGCATAATGCCAAGACAAAGCCGCGGGAGGAGCAGTACAACAGCAC*
*GTACCGTGTGGTCAGCGTCCTCACCGTCCTGCACCAGGACTGGCTGAATGGCAAGGAGTACAAGT*
*GCAAGGTCTCCAACAAAGCCCTCCCAGCCCCCATCGAGAAAACCATCTCCAAAGCCAAAGGGCAG*
*CCCCGAGAACCACAGGTGTACACCCTGCCCCCATCCCGGGAGGAGATGACCAAGAACCAGGTCAG*
*CCTGACCTGCCTGGTCAAAGGCTTCTATCCCAGCGACATCGCCGTGGAGTGGGAGAGCAATGGGC*
*AGCCGGAGAACAACTACAAGACCACGCCTCCCGTGCTGGACTCCGACGGCTCCTTCTTCCTCTAC*
*AGCAAGCTCACCGTGGACAAGAGCAGATGGCAGCAGGGGAACGTCTTCTCATGCTCCGTGATGCA*
*CGAGGCTCTGCACAACCACTACACGCAGAAGTCCCTCTCCCTGTCTCCGGGTAAA*<u>*TAGTGA*</u>
(SEQ ID NO:258)

Single underline     human IL2 signal
Bold and italicized   CD80 (K86A)
Double underlined   (G4S)4
Bold   human A0201 MHC Class I H chain with Y84C double underlined
Bold and double underlined   AAAGG spacer coding
Italicized   human IgG1 Fc (LALA)
Single underlined and italicized   stop codons

FIG. 14D
2456

**_VIHVTKEVKEVATLSCGHNVSVEELAQTRIYWQKEKKMVLTMMSGDMNIWPEYKNRTIF
DITNNLSIVILALRPSDEGTYECVVLAYEKDAFKREHLAEVTLSVKADFPTPSISDFEI
PTSNIRRIICSTSGGFPEPHLSWLENGEELNAINTTVSQDPETELYAVSSKLDFNMTTN
HSFMCLIKYGHLRVNQTFNWNTTKQEHFPDN_<u>GGGGSGGGGSGGGGSGGGGSGS</u>HSMRYF
FTSVSRPGRGEPRFIAVGYVDDTQFVRFDSDAASQRMEPRAPWIEQEGPEYWDGETRKV
KAHSQTHRVDLGTLRG<u>C</u>YNQSEAGSHTVQRMYGCDVGSDWRFLRGYHQYAYDGKDYIAL
KEDLRSWTAADMAAQTTKHKWEAAHVAEQLRAYLEGTCVEWLRRYLENGKETLQRTDAP
KTHMTHHAVSDHEATLRCWALSFYPAEITLTWQRDGEDQTQDTELVETRPCGDGTFQKW
AAVVVPSGQEQRYTCHVQHEGLPKPLTLRWE<u>AAAGG**</u>_DKTHTCPPCPAPEAAGGPSVFLF
PPKPKDTLMISRTPEVTCVVVDVSHEDPEVKFNWYVDGVEVHNAKTKPREEQYNSTYRV
VSVLTVLHQDWLNGKEYKCKVSNKALPAPIEKTISKAKGQPREPQVYTLPPSREEMTKN
QVSLTCLVKGFYPSDIAVEWESNGQPENNYKTTPPVLDSDGSFFLYSKLTVDKSRWQQG
NVFSCSVMHEALHNHYTQKSLSLSPGK_ (SEQ ID NO:259)

Bold and italicized    CD80 (K86A)
Double underlined   (G4S)4
Bold   human A0201 MHC Class I H chain with Y84C double underlined
Bold and double underlined    AAAGG spacer
Italicized   human IgG1 Fc (LALA)

ATGTCTCGCTCCGTGGCCTTAGCTGTGCTCGCGCTACTCTCTCTTTCTGGCCTGGAGGCC*TTCCT*
*GCCCTCCGACTTCTTCCCCTCCGTG*GGTGGAGGTGGTTCTGGAGGAGGCGGTTCGGGCGGAGGTG
GTAGT*ATCCAGCGTACTCCAAAGATTCAGGTTTACTCATGCCATCCAGCAGAGAATGGAAAGTCA*
*AATTTCCTGAATTGCTATGTGTCTGGGTTTCATCCATCCGACATTGAAGTTGACTTACTGAAGAA*
*TGGAGAGAGAATTGAAAAGTGGAGCATTCAGACTTGTCTTTCAGCAAGGACTGGTCTTTCTATC*
*TCTTGTATTATACTGAATTCACCCCCACTGAAAAAGATGAGTATGCCTGCCGTGTGAACCACGTG*
*ACTTTGTCACAGCCCAAGATAGTTAAGTGGGATCGAGACAT*GGGTGGCGGGGGGTCCGGAGGAGG
TGGATCCGGCGGAGGGGGATCTGGCGGAGGCGGATCAGGAGGTGGCGGCTCTGACCCTGCAGGCC
TGCTGGATCTGCGGCAGGGCATGTTCGCACAACTCGTGGCCCAGAACGTGCTGCTGATCGATGGA
CCGCTGTCCTGGTACTCCGACCCGGGACTTGCCGGAGTGTCACTGACTGGAGGATTGTCCTACGC
CGAAGATACGAAGGAGCTCGTCGTGGCGAAGGCCGGAGTGTACTATGTGTTCTTCCAGCTCGAAC
TCCGGAGAGTCGTGGCCGGGGAAGGCTCCGGCTCCGTGTCACTTGCCCTGCACCTCCAGCCACTT
CGGTCGGCCGCTGGAGCCGCCGCACTGGCCCTGACCGTCGACCTCCCTCCTGCGTCCTCCGAGGC
TCGCAACTCGGCCTTCGGATTCCAAGGGCGCCTTCTGCACCTGTCCGCGGGACAGAGGCTGGGGG
TGCATCTGCATACTGAAGCGCGGGCACGGCATGCTTGGCAGCTGACTCAGGGAGCAACTGTCCTG
GGTCTGTTCCGCGTGACTCCGGAAATCCCCGCCGGTGGAGGTGGCTCAGGAGGCGGCGGCAGCGG
TGGAGGAGGGAGCGGAGGAGGCGGATCCGGTGGAGGCGGAAGCGACCCTGCCGGACTCCTGGATC
TGCGGCAGGGCATGTTCGCCCAGTTGGTGGCGCAGAACGTCCTGCTCATTGACGGGCCGCTGTCG
TGGTACAGCGATCCGGGCTTGGCCGGAGTCTCGCTGACCGGAGGACTCAGCTACGCCGAAGATAC
CAAGGAGCTGGTCGTGGCCAAGGCCGGAGTGTACTACGTGTTCTTCCAACTGGAACTGCGCCGGG
TGGTGGCTGGCGAAGGATCCGGGTCGGTGTCCCTGGCCCTGCATCTGCAGCCTCTGCGCTCAGCC
GCAGGAGCAGCCGCCTTGGCGCTCACCGTGGACCTTCCGCCCGCCTCCTCGGAAGCCCGGAACAG
CGCCTTCGGCTTCCAAGGCAGACTCCTGCACTTGAGCGCGGGCCAGAGACTGGGAGTGCACCTCC
ACACCGAAGCGCGCAAGGCACGCCTGGCAGCTCACCCAGGGAGCCACCGTGCTGGGCTTGTTT
CGAGTCACCCCCGAGATCCCAGCCGGCGGAGGAGGTTCCGGTGGCGGTGGATCAGGCGGTGGAGG
CTCGGGTGGAGGGGGTAGCGGAGGGGGTGGTTCCGACCCCGCAGGACTGCTGGACCTCCGGCAGG
GGATGTTCGCGCAACTGGTGGCTCAGAATGTCCTGCTGATTGACGGCCCCCTGTCGTGGTACTCG
GACCCTGGCCTTGCCGGCGTGTCCTTGACTGGAGGGCTGTCGTACGCCGAGGACACTAAGGAGCT
GGTCGTGGCCAAAGCCGGCGTGTACTACGTGTTCTTTCAGCTGGAACTGAGGAGAGTGGTGGCGG
GAGAAGGCAGCGGCTCAGTGTCCCTCGCCCTGCACCTTCAACCACTCCGCTCTGCCGCTGGTGCA
GCTGCGCTCGCCCTCACTGTGGATCTTCACCGGCAAGCTCCGAGGCCAGAAACTCCGCCTTCGG
GTTCCAGGGGAGGCTGCTGCATCTCTCCGCCGGCCAGAGACTGGGCGTGCACTTGCACACTGAGG
CTAGGGCTCGCCATGCCTGGCAGCTGACCCAGGGCGCCACTGTGCTGGGACTGTTCCGGGTGACC
CCAGAAATCCCGGCCTCC*TAGTGA* (SEQ ID NO:260)

Single underline β2M leader
bold and italicized HBV (C18-27) epitope
double underlined (G4S)3
italicized human β2M
double underlined (G4S)5
bold 4-1BBL (K127A)
single underlined and italicized stop codons

FIG. 15B
2453

*FLPSDFFPSV*GGGGSGGGGSGGGGS *IQRTPKIQVYSCHPAENGKSNFLNCYVSGFHPSD*
*IEVDLLKNGERIEKVEHSDLSFSKDWSFYLLYYTEFTPTEKDEYACRVNHVTLSQPKIV*
*KWDRDM*GGGGSGGGGSGGGGSGGGGSGGGGSDPAGLLDLRQGMFAQLVAQNVLLIDGPL
SWYSDPGLAGVSLTGGLSYAEDTKELVVAKAGVYYVFFQLELRRVVAGEGSGSVSLALH
LQPLRSAAGAAALALTVDLPPASSEARNSAFGFQGRLLHLSAGQRLGVHLHTEARARHA
WQLTQGATVLGLFRVTPEIPAGGGGSGGGGSGGGGSGGGGSGGGGSDPAGLLDLRQGMF
AQLVAQNVLLIDGPLSWYSDPGLAGVSLTGGLSYAEDTKELVVAKAGVYYVFFQLELRR
VVAGEGSGSVSLALHLQPLRSAAGAAALALTVDLPPASSEARNSAFGFQGRLLHLSAGQ
RLGVHLHTEARARHAWQLTQGATVLGLFRVTPEIPAGGGGSGGGGSGGGGSGGGGSGGG
GSDPAGLLDLRQGMFAQLVAQNVLLIDGPLSWYSDPGLAGVSLTGGLSYAEDTKELVVA
KAGVYYVFFQLELRRVVAGEGSGSVSLALHLQPLRSAAGAAALALTVDLPPASSEARNS
AFGFQGRLLHLSAGQRLGVHLHTEARARHAWQLTQGATVLGLFRVTPEIPAS (SEQ
ID NO:261)

bold and italicized   HBV (C18-27) epitope
double underlined    (G4S)3
italicized           human β2M
double underlined    (G4S)5
bold                 4-1BBL (K127A)

FIG. 15C
2454

ATGTCTCGCTCCGTGGCCTTAGCTGTGCTCGCGCTACTCTCTCTTTCTGGCCTGGAGGCC*TTCCT*
*GCCCTCCGACTTCTTCCCCTCCGTG*<u>GGT TGCGGTGGTTCTGGAGGAGGCGGTTCGGGCGGAGGTG</u>
<u>GTAGT</u>*ATCCAGCGTACTCCAAAGATTCAGGTTTACTCATGCCATCCAGCAGAGAATGGAAAGTCA*
*AATTTCCTGAATTGCTATGTGTCTGGGTTTCATCCATCCGACATTGAAGTTGACTTACTGAAGAA*
*TGGAGAGAGAATTGAAAAAGTGGAGCATTCAGACTTGTCTTTCAGCAAGGACTGGTCTTTCTATC*
*TCTTGTATTATACTGAATTCACCCCCACTGAAAAAGATGAGTATGCCTGCCGTGTGAACCACGTG*
*ACTTTGTCACAGCCCAAGATAGTTAAGTGGGATCGAGACAT*<u>GGGTGGCGGGGGGTCCGGAGGAGG</u>
<u>TGGATCCGGCGGAGGGGGATCTGGCGGAGGCGGATCAGGAGGTGGCGGCTCT</u>GACCCTGCAGGCC
TGCTGGATCTGCGGCAGGGCATGTTCGCACAACTCGTGGCCCAGAACGTGCTGCTGATCGATGGA
CCGCTGTCCTGGTACTCCGACCCGGGACTTGCCGGAGTGTCACTGACTGGAGGATTGTCCTACGC
CGAAGATACGAAGGAGCTCGTCGTGGCGAAGGCCGGAGTGTACTATGTGTTCTTCCAGCTCGAAC
TCCGGAGAGTCGTGGCCGGGGAAGGCTCCGGCTCCGTGTCACTTGCCCTGCACCTCCAGCCACTT
CGGTCGGCCGCTGGAGCCGCCGCACTGGCCCTGACCGTCGACCTCCCTCCTGCGTCCTCCGAGGC
TCGCAACTCGGCCTTCGGATTCCAAGGGCGCCTTCTGCACCTGTCCGCGGGACAGAGGCTGGGGG
TGCATCTGCATACTGAAGCGCGGGCACGGCATGCTTGGCAGCTGACTCAGGGAGCAACTGTCCTG
GGTCTGTTCCGCGTGACTCCGGAAATCCCCGCC<u>GGTGGAGGTGGCTCAGGAGGCGGCGGCAGCGG</u>
<u>TGGAGGAGGGAGCGGAGGAGGCGGATCCGGTGGAGGCGGAAGC</u>GACCCTGCCGGACTCCTGGATC
TGCGGCAGGGCATGTTCGCCCAGTTGGTGGCGCAGAACGTCCTGCTCATTGACGGGCCGCTGTCG
TGGTACAGCGATCCGGGCTTGGCCGGAGTCTCGCTGACCGGAGGACTCAGCTACGCCGAAGATAC
CAAGGAGCTGGTCGTGGCCAAGGCCGGAGTGTACTACGTGTTCTTCCAACTGGAACTGCGCCGGG
TGGTGGCTGGCGAAGGATCCGGGTCGGTGTCCCTGGCCCTGCATCTGCAGCCTCTGCGCTCAGCC
GCAGGAGCAGCCGCCTTGGCGCTCACCGTGGACCTTCCGCCCGCCTCCTCGGAAGCCCGGAACAG
CGCCTTCGGCTTCCAAGGCAGACTCCTGCACTTGAGCGCGGGCCAGAGACTGGGAGTGCACCTCC
ACACCGAAGCGCGCGCAAGGCACGCCTGGCAGCTCACCCAGGGAGCCACCGTGCTGGGCTTGTTT
CGAGTCACCCCCGAGATCCCAGCC<u>GGCGGAGGAGGTTCCGGTGGCGGTGGATCAGGCGGTGGAGG</u>
<u>CTCGGGTGGAGGGGGTAGCGGAGGGGGTGGTTCC</u>GACCCCGCAGGACTGCTGGACCTCCGGCAGG
GGATGTTCGCGCAACTGGTGGCTCAGAATGTCCTGCTGATTGACGGCCCCCTGTCGTGGTACTCG
GACCCTGGCCTTGCCGGCGTGTCCTTGACTGGAGGGCTGTCGTACGCCGAGGACACTAAGGAGCT
GGTCGTGGCCAAAGCCGGCGTGTACTACGTGTTCTTTCAGCTGGAACTGAGGAGAGTGGTGGCGG
GAGAAGGCAGCGGCTCAGTGTCCCTCGCCCTGCACCTTCAACCACTCCGCTCTGCCGCTGGTGCA
GCTGCGCTCGCCCTCACTGTGGATCTTCACCGGCAAGCTCCGAGGCCAGAAACTCCGCCTTCGG
GTTCCAGGGGAGGCTGCTGCATCTCTCCGCCGGCCAGAGACTGGGCGTGCACTTGCACACTGAGG
CTAGGGCTCGCCATGCCTGGCAGCTGACCCAGGGCGCCACTGTGCTGGGACTGTTCCGGGTGACC
CCAGAAATCCCGGCCTCCTAG<u>*TGA*</u> (SEQ ID NO:262)

Single underline  β2M leader
bold and italicized  HBV (C18-27) epitope
double underlined  (G4S)3 with Gly-to-Cys substitution at second Gly (bold and italicized)
italicized  human β2M
double underlined  (G4S)5
bold  4-1BBL (K127A)
single underlined and italicized  stop codons

FIG. 15D
2454

FLPSDFFPSVG*C*GGSGGGGSGGGGS *IQRTPKIQVYSCHPAENGKSNFLNCYVSGFHPSD*
*IEVDLLKNGERIEKVEHSDLSFSKDWSFYLLYYTEFTPTEKDEYACRVNHVTLSQPKIV*
*KWDRDM*GGGGSGGGGSGGGGSGGGGSGGGGSDPAGLLDLRQGMFAQLVAQNVLLIDGPL
SWYSDPGLAGVSLTGGLSYAEDTKELVVAKAGVYYVFFQLELRRVVAGEGSGSVSLALH
LQPLRSAAGAAALALTVDLPPASSEARNSAFGFQGRLLHLSAGQRLGVHLHTEARARHA
WQLTQGATVLGLFRVTPEIPAGGGGSGGGGSGGGGSGGGGSGGGGSDPAGLLDLRQGMF
AQLVAQNVLLIDGPLSWYSDPGLAGVSLTGGLSYAEDTKELVVAKAGVYYVFFQLELRR
VVAGEGSGSVSLALHLQPLRSAAGAAALALTVDLPPASSEARNSAFGFQGRLLHLSAGQ
RLGVHLHTEARARHAWQLTQGATVLGLFRVTPEIPAGGGGSGGGGSGGGGSGGGGSGGG
GSDPAGLLDLRQGMFAQLVAQNVLLIDGPLSWYSDPGLAGVSLTGGLSYAEDTKELVVA
KAGVYYVFFQLELRRVVAGEGSGSVSLALHLQPLRSAAGAAALALTVDLPPASSEARNS
AFGFQGRLLHLSAGQRLGVHLHTEARARHAWQLTQGATVLGLFRVTPEIPAS (SEQ
ID NO:263)

bold and italicized   HBV (C18-27) epitope
double underlined   (G4S)3 with Gly-to-Cys substitution at second Gly (bold and italicized)
italicized   human β2M
double underlined   (G4S)5
bold   4-1BBL (K127A)

ATGTCTCGCTCCGTGGCCTTAGCTGTGCTCGCGCTACTCTCTCTTTCTGGCCTGGAGGCC*AACCT GGTGCCGATGGTGGCGACCGTG*GGGGGAGGAGCCTCAGGAGGAGGAGGATCCGGGGGTGGAGGTA GCATCCAGCGTACTCCAAAGATTCAGGTTTACTCATGCCATCCAGCAGAGAATGGAAAGTCAAAT TTCCTGAATTGCTATGTGTCTGGGTTTCATCCATCCGACATTGAAGTTGACTTACTGAAGAATGG AGAGAGAATTGAAAAAGTGGAGCATTCAGACTTGTCTTTCAGCAAGGACTGGTCTTTCTATCTCT TGTATTATACTGAATTCACCCCCACTGAAAAAGATGAGTATGCCTGCCGTGTGAACCACGTGACT TTGTCACAGCCCAAGATAGTTAAGTGGGATCGAGACATG*TGATAG* (SEQ ID NO:264)

Single underline   β2M leader
Bold and italicized   CMV pp65 (495-503) epitope
Double underlined   linker
Bold   β2M
Single underlined and italicized   stop codons

*NLVPMVATV*GGGASGGGGSGGGGSIQRTPKIQVYSCHPAENGKSNFLNCYVSGFHPSDI EVDLLKNGERIEKVEHSDLSFSKDWSFYLLYYTEFTPTEKDEYACRVNHVTLSQPKIVK WDRDM (SEQ ID NO:265)

Bold and italicized   CMV pp65 (495-503) epitope
Double underlined   linker
Bold   β2M

ATGTCTCGCTCCGTGGCCTTAGCTGTGCTCGCGCTACTCTCTCTTTCTGGCCTGGAGGCC*AACCT GGTGCCGATGGTGGCGACCGTG*GGG*TGC*GGAGGCTCAGGAGGAGGAGGATCCGGGGGTGGAGGTA GCATCCAGCGTACTCCAAAGATTCAGGTTTACTCATGCCATCCAGCAGAGAATGGAAAGTCAAAT TTCCTGAATTGCTATGTGTCTGGGTTTCATCCATCCGACATTGAAGTTGACTTACTGAAGAATGG AGAGAGAATTGAAAAAGTGGAGCATTCAGACTTGTCTTTCAGCAAGGACTGGTCTTTCTATCTCT TGTATTATACTGAATTCACCCCCACTGAAAAAGATGAGTATGCCTGCCGTGTGAACCACGTGACT TTGTCACAGCCCAAGATAGTTAAGTGGGATCGAGACATG*TGATAG* (SEQ ID NO:266)

Single underline   β2M signal
Bold and italicized   CMV epitope
Double underlined   linker with Cys-encoding codon in bold and italicized
Bold   β2M
Single underlined and italicized   stop codons

FIG. 16D
1717

_NLVPMVATV_<u>GCGGSGGGGSGGGGS</u>IQRTPKIQVYSCHPAENGKSNFLNCYVSGFHPSDIEVDLLK NGERIEKVEHSDLSFSKDWSFYLLYYTEFTPTEKDEYACRVNHVTLSQPKIVKWDRDM (SEQ ID NO:267)

Bold and italicized    CMV epitope
Double underlined    linker with Cys in bold and italicized
Bold    β2M

FIG. 17A
2723

ATGTCTCGCTCCGTGGCCTTAGCTGTGCTCGCGCTACTCTCTCTTTCTGGCCTGGAGGCC***GGCCT
GTCCCGGTACGTGGCCCGGCTG***<u>GGTGGAGGTGGTTCTGGAGGAGGCGGTTCGGGCGGAGGTGGTA
GT</u>ATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG<u>*TAGTGA*</u> (SEQ ID NO:268)

Single underline  β2M leader
Bold and italicized  HBV Pol (455-463) epitope
Double underlined  (G4S)3 linker
Bold  human β2M
single underlined and italicized  stop codons

FIG. 17B
2723

*GLSRYVARLG*<u>GGGSGGGGSGGGGS</u>**IQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM** (SEQ ID NO:269)

Bold and italicized  HBV Pol (455-463) epitope
Double underlined  (G4S)3 linker
Bold  human β2M

FIG. 17C
2724

ATGTCTCGCTCCGTGGCCTTAGCTGTGCTCGCGCTACTCTCTCTTTCTGGCCTGGAGGCC***GGCCT
GTCCCGGTACGTGGCCCGGCTG*GGT *TGC***GGTGGTTCTGGAGGAGGCGGTTCGGGCGGAGGTGGTA
GTATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG*TAGTGA* (SEQ ID NO:270)

Single underline   β2M leader
Bold and italicized   HBV Pol (455-463) epitope
Double underlined   linker (G4S)3 with Gly-to-Cys substitution at second Gly (bold and italicized)
Bold   human β2M
single underlined and italicized   stop codons

FIG. 17D
2724

*GLSRYVARL*GCGGSGGGGSGGGGSIQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM (SEQ ID NO:271)

Bold and italicized   HBV Pol (455-463) epitope
Double underlined   linker (G4S)3 with Gly-to-Cys substitution at second Gly (bold and italicized)
Bold   human β2M

FIG. 18A
2725

ATGTCTCGCTCCGTGGCCTTAGCTGTGCTCGCGCTACTCTCTCTTTCTGGCCTGGAGGCC*AAGCT GCACCTGTACTCCCACCCCATC*<u>GGTGGAGGTGGTTCTGGAGGAGGCGGTTCGGGCGGAGGTGGTA GT</u>ATCCAGCGTACTCCAAAGATTCAGGTTTACTCATGCCATCCAGCAGAGAATGGAAAGTCAAAT TTCCTGAATTGCTATGTGTCTGGGTTTCATCCATCCGACATTGAAGTTGACTTACTGAAGAATGG AGAGAGAATTGAAAAAGTGGAGCATTCAGACTTGTCTTTCAGCAAGGACTGGTCTTTCTATCTCT TGTATTATACTGAATTCACCCCCACTGAAAAAGATGAGTATGCCTGCCGTGTGAACCACGTGACT TTGTCACAGCCCAAGATAGTTAAGTGGGATCGAGACATG<u>*TAGTGA*</u> (SEQ ID NO:272)

Single underline   β2M leader
Bold and italicized   HBV Pol (502-510)
Double underlined   (G4S)3 linker
Bold   human β2M
single underlined and italicized   stop codons

FIG. 18B
2725

*KLHLYSHPI*<u>GGGGSGGGGSGGGGS</u>IQRTPKIQVYSCHPAENGKSNFLNCYVSGFHPSDIEVDLLK NGERIEKVEHSDLSFSKDWSFYLLYYTEFTPTEKDEYACRVNHVTLSQPKIVKWDRDM (SEQ ID NO:273)

Bold and italicized   HBV Pol (502-510)
Double underlined   (G4S)3 linker
Bold   human β2M

FIG. 18C
2726

ATGTCTCGCTCCGTGGCCTTAGCTGTGCTCGCGCTACTCTCTCTTTCTGGCCTGGAGGCC**AAGCT
GCACCTGTACTCCCACCCCATCGGT TGC**GGTGGTTCTGGAGGAGGCGGTTCGGGCGGAGGTGGTA
GTATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG*TAGTGA* (SEQ ID NO:274)

Single underline   β2M leader
Bold and italicized   HBV Pol (502-510)
Double underlined   linker (G4S)3 with Gly-to-Cys substitution at second Gly (bold and italicized)
Bold   human β2M
single underlined and italicized   stop codons

FIG. 18D
2726

*KLHLYSHPIG**C*<u>GGSGGGGSGGGGS</u>**IQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM** (SEQ ID NO:275)

Bold and italicized   HBV Pol (502-510)
Double underlined   linker (G4S)3 with Gly-to-Cys substitution at second Gly (bold and italicized)
Bold   human β2M

ATGTCTCGCTCCGTGGCCTTAGCTGTGCTCGCGCTACTCTCTCTTTCTGGCCTGGAGGCC_TTCCT_
_GCTGTCCCTGGGCATCCACCTG_GGTGGAGGTGGTTCTGGAGGAGGCGGTTCGGGCGGAGGTGGTA
GTATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG_TAGTGA_ (SEQ ID NO:276)

Single underline   β2M leader
Bold and italicized   HBV Pol (575-583)
Double underlined   (G4S)3 linker
Bold   human β2M
single underlined and italicized   stop codons

_FLLSLGIHL_GGGGSGGGGSGGGGSIQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM (SEQ
ID NO:277)

Bold and italicized   HBV Pol (575-583)
Double underlined   (G4S)3 linker
Bold   human β2M

FIG. 19C
2728

ATGTCTCGCTCCGTGGCCTTAGCTGTGCTCGCGCTACTCTCTCTTTCTGGCCTGGAGGCC***TTCCT
GCTGTCCCTGGGCATCCACCTG*<u>GGT TGC**GGTGGTTCTGGAGGAGGCGGTTCGGGCGGAGGTGGTA
GT</u>ATCCAGCGTACTCCAAAGATTCAGGTTTACTCATGCCATCCAGCAGAGAATGGAAAGTCAAAT
TCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG<u>*TAGTGA*</u> (SEQ ID NO:278)

Single underline  β2M leader
Bold and italicized  HBV Pol (575-583)
Double underlined  (G4S)3 linker with Gly-to-Cys substitution at second Gly (bold and italicized)
Bold  human β2M
single underlined and italicized  stop codons

FIG. 19D
2728

<u>FLLSLGIHL</u>***G*CGGSGGGGSGGGGSIQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM** (SEQ ID NO:279)

Bold and italicized  HBV Pol (575-583)
Double underlined  (G4S)3 linker with Gly-to-Cys substitution at second Gly (bold and italicized)
Bold  human β2M

FIG. 20A
2729

ATGTCTCGCTCCGTGGCCTTAGCTGTGCTCGCGCTACTCTCTCTTTCTGGCCTGGAGGCC***GCCCT
GATGCCCCTGTACGCCTGCATC***GGTGGAGGTGGTTCTGGAGGAGGCGGTTCGGGCGGAGGTGGTA
GTATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG*TAGTGA* (SEQ ID NO:280)

Single underline  β2M leader
Bold and italicized  HBV Pol (655-663)
Double underlined  (G4S)3 linker
Bold  human β2M
single underlined and italicized  stop codons

FIG. 20B
2729

*ALMPLYACI*GGGGSGGGGSGGGGSIQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM (SEQ
ID NO:281)

Bold and italicized  HBV Pol (655-663)
Double underlined  (G4S)3 linker
Bold  human β2M

FIG. 20C
2730

<u>ATGTCTCGCTCCGTGGCCTTAGCTGTGCTCGCGCTACTCTCTCTTTCTGGCCTGGAGGCC</u>***GCCCT
GATGCCCCTGTACGCCTGCATC*<u>GGT TGC**GGTGGTTCTGGAGGAGGCGGTTCGGGCGGAGGTGGTA
GT</u>ATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG<u>*TAGTGA*</u> (SEQ ID NO:282)

Single underline    β2M leader
Bold and italicized    HBV Pol (655-663)
Double underlined    (G4S)3 linker with Gly-to-Cys substitution at second Gly (bold and italicized)
Bold    human β2M
single underlined and italicized    stop codons

FIG. 20D
2730

*ALMPLYACI*<u>GCGGSGGGGSGGGGS</u>IQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM (SEQ ID NO:283)

Bold and italicized    HBV Pol (655-663)
Double underlined    (G4S)3 linker with Gly-to-Cys substitution at second Gly (bold and italicized)
Bold    human β2M

FIG. 21A
2731

ATGTCTCGCTCCGTGGCCTTAGCTGTGCTCGCGCTACTCTCTCTTTCTGGCCTGGAGGCC*TCCCT*
*GTACGCCGACTCCCCCTCCGTG*GGTGGAGGTGGTTCTGGAGGAGGCGGTTCGGGCGGAGGTGGTA
GTATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG*TAGTGA* (SEQ ID NO:284)

Single underline   β2M leader
Bold and italicized   HBV Pol (816-824)
Double underlined   (G4S)3 linker
Bold   human β2M
single underlined and italicized   stop codons

FIG. 21B
2731

*SLYADSPSV*GGGGSGGGGSGGGGSIQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM (SEQ
ID NO:285)

Bold and italicized   HBV Pol (816-824)
Double underlined   (G4S)3 linker
Bold   human β2M

FIG. 21C
2732

<u>ATGTCTCGCTCCGTGGCCTTAGCTGTGCTCGCGCTACTCTCTCTTTCTGGCCTGGAGGCC</u>*TCCCT*
*GTACGCCGACTCCCCCTCCGTG*<u>GGT</u> *TGC*<u>GGTGGTTCTGGAGGAGGCGGTTCGGGCGGAGGTGGTA</u>
GTATCCAGCGTACTCCAAAGATTCAGGTTTACTCATGCCATCCAGCAGAGAATGGAAAGTCAAAT
TTCCTGAATTGCTATGTGTCTGGGTTTCATCCATCCGACATTGAAGTTGACTTACTGAAGAATGG
AGAGAGAATTGAAAAAGTGGAGCATTCAGACTTGTCTTTCAGCAAGGACTGGTCTTTCTATCTCT
TGTATTATACTGAATTCACCCCCACTGAAAAAGATGAGTATGCCTGCCGTGTGAACCACGTGACT
TTGTCACAGCCCAAGATAGTTAAGTGGGATCGAGACATG<u>*TAGTGA*</u> (SEQ ID NO:286)

Single underline – β2M leader
Bold and italicized – HBV Pol (816-824)
Double underlined – (G4S)3 linker with Gly-to-Cys substitution at second Gly (bold and italicized)
Bold – human β2M
single underlined and italicized – stop codons

FIG. 21D
2732

*SLYADSPSV*<u>G</u>*C*<u>GGSGGGGSGGGGS</u>IQRTPKIQVYSCHPAENGKSNFLNCYVSGFHPSDIEVDLLK
NGERIEKVEHSDLSFSKDWSFYLLYYTEFTPTEKDEYACRVNHVTLSQPKIVKWDRDM (SEQ ID NO:287)

Bold and italicized – HBV Pol (816-824)
Double underlined – (G4S)3 linker with Gly-to-Cys substitution at second Gly (bold and italicized)
Bold – human β2M

FIG. 22A

1777 – hIL-2 signal; hIL2 (H16A; F42A); (G4S)4 linker; hIL2 (H16A; F42A); HLA A11 H chain (Y84A; A236C); AAAGG linker; hIgG1 Fc (L234A; L235A)

MYRMQLLSCIALSLALVTNSAPTSSSTKKTQLQLEALLLDLQMILNGINNYKNPK
LTRMLTAKFYMPKKATELKHLQCLEEELKPLEEVLNLAQSKNFHLRPRDLISNIN
VIVLELKGSETTFMCEYADETATIVEFLNRWITFCQSIISTLT*GGGGSGGGGSGGG
GSGGGGS*APTSSSTKKTQLQLEALLLDLQMILNGINNYKNPKLTRMLTAKFYMP
KKATELKHLQCLEEELKPLEEVLNLAQSKNFHLRPRDLISNINVIVLELKGSETTF
MCEYADETATIVEFLNRWITFCQSIISTLT*GGGGSGGGGSGGGGSGGGGS*GSHSM
RYFYTSVSRPGRGEPRFIAVGYVDDTQFVRFDSDAASQRMEPRAPWIEQEGPEY
WDQETRNVKAQSQTDRVDLGTLRGAYNQSEDGSHTIQIMYGCDVGPDGRFLRG
YRQDAYDGKDYIALNEDLRSWTAADMAAQITKRKWEAAHAAEQQRAYLEGTC
VEWLRRYLENGKETLQRTDPPKTHMTHHPISDHEATLRCWALGFYPAEITLTWQ
RDGEDQTQDTELVETRPCGDGTFQKWAAVVVPSGEEQRYTCHVQHEGLPKPLT
LRWE*AAAGG*DKTHTCPPCPAPEAAGGPSVFLFPPKPKDTLMISRTPEVTCVVVDV
SHEDPEVKFNWYVDGVEVHNAKTKPREEQYNSTYRVVSVLTVLHQDWLNGKE
YKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSV
MHEALHNHYTQKSLSLSPGK

FIG. 22B

1781 – hIL-2 signal; hIL2 (H16A; F42A); (G4S)4 linker; hIL2 (H16A; F42A); (G4S)4 linker; HLA-A A11 (Y84A; A236C); (G4S)6 linker; hIgG1 Fc (L234A; L235A)

MYRMQLLSCIALSLALVTNSAPTSSSTKKTQLQLEALLLDLQMILNGINNYKNPK
LTRMLTAKFYMPKKATELKHLQCLEEELKPLEEVLNLAQSKNFHLRPRDLISNIN
VIVLELKGSETTFMCEYADETATIVEFLNRWITFCQSIISTLT*GGGGSGGGGSGGG
GSGGGGS*APTSSSTKKTQLQLEALLLDLQMILNGINNYKNPKLTRMLTAKFYMP
KKATELKHLQCLEEELKPLEEVLNLAQSKNFHLRPRDLISNINVIVLELKGSETTF
MCEYADETATIVEFLNRWITFCQSIISTLT*GGGGSGGGGSGGGGSGGGGS*GSHSM
RYFYTSVSRPGRGEPRFIAVGYVDDTQFVRFDSDAASQRMEPRAPWIEQEGPEY
WDQETRNVKAQSQTDRVDLGTLRGAYNQSEDGSHTIQIMYGCDVGPDGRFLRG
YRQDAYDGKDYIALNEDLRSWTAADMAAQITKRKWEAAHAAEQQRAYLEGTC
VEWLRRYLENGKETLQRTDPPKTHMTHHPISDHEATLRCWALGFYPAEITLTWQ
RDGEDQTQDTELVETRPCGDGTFQKWAAVVVPSGEEQRYTCHVQHEGLPKPLT
LRWE*GGGGSGGGGSGGGGSGGGGSGGGGSGGGGS*DKTHTCPPCPAPEAAGGPS
VFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQ
VYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK

FIG. 23A
1783 – β2M leader; HBV epitope; (G4S)3 linker; human β2M (R12C)

MSRSVALAVLALLSLSGLEALIMPARFYPK*GGGGSGGGGSGGGG*SIQRTPKIQVY
S<u>C</u>HPAENGKSNFLNCYVSGFHPSDIEVDLLKNGERIEKVEHSDLSFSKDWSFYLL
YYTEFTPTEKDEYACRVNHVTLSQPKIVKWDRDM epitope: LIMPARFYPK

FIG. 23B

1784 – β2M leader; HBV epitope; (G4S)3 linker; human β2M (R12C)

MSRSVALAVLALLSLSGLEAAIMPARFYPK*GGGGSGGGGSGGGG*SIQRTPKIQV
YS<u>C</u>HPAENGKSNFLNCYVSGFHPSDIEVDLLKNGERIEKVEHSDLSFSKDWSFYL
LYYTEFTPTEKDEYACRVNHVTLSQPKIVKWDRDM epitope: AIMPARFYPK

FIG. 23C
1785 – β2M leader; HBV epitope; (G4S)3 linker; human β2M (R12C)

MSRSVALAVLALLSLSGLEAYVNVNMGLK*GGGGSGGGGSGGGG*SIQRTPKIQV
YS<u>C</u>HPAENGKSNFLNCYVSGFHPSDIEVDLLKNGERIEKVEHSDLSFSKDWSFYL
LYYTEFTPTEKDEYACRVNHVTLSQPKIVKWDRDM epitope: YVNVNMGLK

FIG. 23D
1938 – β2M leader; HBV (C 18-27) epitope; (G4S)3 linker; human β2M (R12C)

MSRSVALAVLALLSLSGLEAFLPSDFFPSV*GGGGSGGGGSGGGG*SIQRTPKIQVY
S<u>C</u>HPAENGKSNFLNCYVSGFHPSDIEVDLLKNGERIEKVEHSDLSFSKDWSFYLL
YYTEFTPTEKDEYACRVNHVTLSQPKIVKWDRDM epitope: FLPSDFFPSV

FIG. 23E
1939 – β2M leader; HBV (C 141-149) epitope; (G4S)3 linker; human β2M (R12C)

MSRSVALAVLALLSLSGLEASTLPETTVV*GGGGSGGGGSGGGG*SIQRTPKIQVYS
<u>C</u>HPAENGKSNFLNCYVSGFHPSDIEVDLLKNGERIEKVEHSDLSFSKDWSFYLLY
YTEFTPTEKDEYACRVNHVTLSQPKIVKWDRDM epitope: STLPETTVV FIG. 24A Homo sapiens HLA-A 24A.1 HLA-A*01:01:01 NCBI (National Center for Biotechnology Information) Accession NP_001229687.1 (SEQ ID NO:216)

```
  1 MAVMAPRTLL LLLSGALALT QTWAGSHSMR YFFTSVSRPG RGEPRFIAVG YVDDTQFVRF
 61 DSDAASQKME PRAPWIEQEG PEYWDQETRN MKAHSQTDRA NLGTLRGYYN QSEDGSHTIQ
121 IMYGCDVGPD GRFLRGYRQD AYDGKDYIAL NEDLRSWTAA DMAAQITKRK WEAVHAAEQR
181 RVYLEGRCVD GLRRYLENGK ETLQRTDPPK THMTHHPISD HEATLRCWAL GFYPAEITLT
241 WQRDGEDQTQ DTELVETRPA GDGTFQKWAA VVVPSGEEQR YTCHVQHEGL PKPLTLRWEL
301 SSQPTIPIVG IIAGLVLLGA VITGAVVAAV MWRRKSSDRK GGSYTQAASS DSAQGSDVSL
361 TACKV
```

24A.2 HLA-A*1101 NCBI Accession P13746.1 (SEQ ID NO:294)

```
  1 MAVMAPRTLL LLLSGALALT QTWAGSHSMR YFYTSVSRPG RGEPRFIAVG YVDDTQFVRF
 61 DSDAASQRME PRAPWIEQEG PEYWDQETRN VKAQSQTDRV DLGTLRGYYN QSEDGSHTIQ
121 IMYGCDVGPD GRFLRGYRQD AYDGKDYIAL NEDLRSWTAA DMAAQITKRK WEAAHAAEQQ
181 RAYLEGRCVE WLRRYLENGK ETLQRTDPPK THMTHHPISD HEATLRCWAL GFYPAEITLT
241 WQRDGEDQTQ DTELVETRPA GDGTFQKWAA VVVPSGEEQR YTCHVQHEGL PKPLTLRWEL
301 SSQPTIPIVG IIAGLVLLGA VITGAVVAAV MWRRKSSDRK GGSYTQAASS DSAQGSDVSL
361 TACKV
```

24A.3 HLA-A*2402 NCBI Accession P05534.2 (SEQ ID NO:295)

```
  1 MAVMAPRTLV LLLSGALALT QTWAGSHSMR YFSTSVSRPG RGEPRFIAVG YVDDTQFVRF
 61 DSDAASQRME PRAPWIEQEG PEYWDEETGK VKAHSQTDRE NLRIALRYYN QSEAGSHTLQ
121 MMFGCDVGSD GRFLRGYHQY AYDGKDYIAL KEDLRSWTAA DMAAQITKRK WEAAHVAEQQ
181 RAYLEGTCVD GLRRYLENGK ETLQRTDPPK THMTHHPISD HEATLRCWAL GFYPAEITLT
241 WQRDGEDQTQ DTELVETRPA GDGTFQKWAA VVVPSGEEQR YTCHVQHEGL PKPLTLRWEP
301 SSQPTIPIVG IIAGLVLLGA VITGAVVAAV MWRRNSSDRK GGSYSQAASS DSAQGSDVSL
361 TACKV
```

FIG. 24A, continued 24A.4   HLA-A*3303 NCBI Accession AAA79865.1 (SEQ ID NO:296)

```
  1 MAVMAPRTLL LLLLGALALT QTWAGSHSMR YFTTSVSRPG RGEPRFIAVG YVDDTQFVRF
 61 DSDAASQRME PRAPWIEQEG PEYWDRNTRN VKAHSQIDRV DLGTLRGYYN QSEAGSHTIQ
121 MMYGCDVGSD GRFLRGYQQD AYDGKDYIAL NEDLRSWTAA DMAAQITQRK WEAARVAEQL
181 RAYLEGTCVE WLRRYLENGK ETLQRTDPPK THMTHHAVSD HEATLRCWAL SFYPAEITLT
241 WQRDGEDQTQ DTELVETRPA GDGTFQKWAS VVVPSGQEQR YTCHVQHEGL PKPLTLRWEP
301 SSQPTIPIVG IIAGLVLFGA VEAGAVVAAV RWRRKSSDRK GGSYSQAASS DSAQGSDMSL
361 TACKV
```

FIG. 24B *Homo sapiens* HLA-B*07:02:01 HLA-B GenBank Accession NP_005505.2
(SEQ ID NO:217)

```
  1 mlvmaprtvl lllsaalalt etwagshsmr yfytsvsrpg rgeprfisvg yvddtqfvrf
 61 dsdaaspree prapwieqeg peywdrntqi ykaqaqtdre slrnlrgyyn qseagshtlq
121 smygcdvgpd grllrghdqy aydgkdyial nedlrswtaa dtaaqitqrk weaareaeqr
181 raylcgccve wlrrylcngk dklcradppk thvthhpisd hcatlrcwal gfypacitlt
241 wqrdgedqtq dtelvetrpa gdrtfqkwaa vvvpsgeeqr ytchvqhegl pkpltlrwep
301 ssqstvpivg ivaglavlav vvigavvaav mcrrkssggk ggsysqaacs dsaqgsdvsl
361 ta
```

FIG. 24C *Homo sapiens* HLA-C
HLA-C GenBank Accession NP_001229971.1

(SEQ ID NO:218)

```
  1 mrvmaprall lllsgglalt etwacshsmr yfdtavsrpg rgeprfisvg yvddtqfvrf
 61 dsdaasprge prapwveqeg peywdretqn ykrqaqadrv slrnlrgyyn qsedgshtlq
121 rmygcdlgpd grllrgydqs aydgkdyial nedlrswtaa dtaaqitqrk leaaraaeql
181 raylegtcve wlrrylengk etlqraeppk thvthhplsd heatlrcwal gfypaeitlt
241 wqrdgedqtq dtelvetrpa gdtfqkwaa vvvpsgqeqr ytchmqhegl qepltlswep
301 ssqptipimg ivaglavlvv lavlgavvta mmcrrkssgg kggscsqaac snsaqgsdes
361 litck
```

Fig. 25

```
HLA-A          GSHSMRYFFTSVSRPGRGEPRFIAVGYVDDTQFVRFDSDAASQKMEPRAPWIEQEGPEYW
HLA-B          GSHSMRYFYTSVSRPGRGEPRFISVGYVDDTQFVRFDSDAASPREEPRAPWIEQEGPEYW
HLA-C          CSHSMRYFDTAVSRPGRGEPRFISVGYVDDTQFVRFDSDAASPRGEPRAPWVEQEGPEYW
HLA-A*0201     GSHSMRYFFTSVSRPGRGEPRFIAVGYVDDTQFVRFDSDAASQRMEPRAPWIEQEGPEYW
Mouse H2K      GPHSLRYFVTAVSRPGLGEPRFIAVGYVDDTQFVRFDSDADNPRFEPRAPWMEQEGPEYW
HLA_A(var. 2)  GSHSMRYFFTSVSRPGRGEPRFIAVGYVDDTQFVRFDSDAASQRMEPRAPWIEQEGPEYW
HLA_A(var. 2C) GSHSMRYFFTSVSRPGRGEPRFIAVGYVDDTQFVRFDSDAASQRMEPRAPWIEQEGPEYW
HLA_A(var.2CP) GSHSMRYFFTSVSRPGRGEPRFIAVGYVDDTQFVRFDSDAASQRMEPRAPWIEQEGPEYW
HLA-A*1101     GSHSMRYFYTSVSRPGRGEPRFIAVGYVDDTQFVRFDSDAASQRMEPRAPWIEQEGPEYW
HLA-A*2402     GSHSMRYFSTSVSRPGRGEPRFIAVGYVDDTQFVRFDSDAASQRMEPRAPWIEQEGPEYW
HLA-A*3303     GSHSMRYFTTSVSRPGRGEPRFIAVGYVDDTQFVRFDSDAASQRMEPRAPWIEQEGPEYW
               **:***  *:***** ******:****************    .:  *****:******
```

84
                                         ↓
```
HLA-A          DQETRNMKAHSQTDRANLGTLRCYYNQSEDGSHTIQIMYGCDVCPDGRFLRGYRQDAYDG
HLA-B          DRNTQIYKAQAQTDRESLRNLRGYYNQSEAGSHTLQSMYGCDVGPDGRLLRGHDQYAYDG
HLA-C          DRETQNYKRQAQADRVSLRNLRGYYNQSEDGSHTLQRMYGCDLGPDGRLLRGYDQSAYDG
HLA-A*0201     DGETRKVKAHSQTHRVDLGTLRGYYNQSEAGSHTVQRMYGCDVGSDWRFLRGYHQYAYDG
MOUSE H2K      EEQTQRAKSDEQWFRVSLRTAQRYYNQSKGGSHTFQRMFGCDVGSDWRLLRGYQQFAYDG
HLA_A(var. 2)  DCETRKVKAHSQTHRVDLGTLRCAYNQSEAGSHTVQRMYGCDVCSDWRFLRGYHQYAYDG
HLA_A(var. 2C) DGETRKVKAHSQTHRVDLGTLRGCYNQSEAGSHTVQRMYGCDVGSDWRFLRGYHQYAYDG
HLA_A(var.2CP) DGETRKVKAHSQTHRVDLGTLRGAYNQSEAGSHTVQRMYGCDVGSDWRFLRGYHQYAYDG
HLA-A*1101     DQETRNVKAQSQTDRVDLGTLRGYYNQSEDGSHTIQIMYGCDVGPDGRFLRGYRQDAYDG
HLA-A*2402     DEETGKVKAHSQTDRENLRIALRYYNQSEAGSHTLQMMFGCDVGSDWRFLRGYHQYAYDG
HLA-A*3303     DRNTRNVKAHSQIDRVDLGTLRCYYNQSEAGSHTIQMMYGCDVCSDGRFLRGYQQDAYDG
                : *     *  .  *  .*   ****: ****.* *:**:* * *:***: * ****
                                 aac1  aac2
```

139
                           ↓
```
HLA-A          KDYIALNEDLRSWTAADMAQITKRKWEAVHAAEQRRVYLEGRCVDGLRRYLENGKETLQ
HLA-B          KDYIALNEDLRSWTAADTAAQITQRKWEAAREAEQRRAYLEGECVEWLRRYLENGKDKLE
HLA-C          KDYIALNEDLRSWTAADTAAQITQRKLEAARAAEQLRAYLEGTCVEWLRRYLENGKETLQ
HLA-A*0201     KDYIALKEDLRSWTAADMAAQTTKHKWEAAHVAEQLRAYLEGTCVEWLRRYLENGKETLQ
MOUSE H2K      RDYIALNEDLKTWTAADTAALITRRKWEQAGDAEYYRAYLEGECVEWLRRYLELGNETLL
HLA_A(var. 2)  KDYIALKEDLRSWTAADMAAQTTKHKWEAAHVAEQLRAYLEGTCVEWLRRYLENGKETLQ
HLA_A(var. 2C) KDYIALKEDLRSWTAADMCAQTTKHKWEAAHVAEQLRAYLEGTCVEWLRRYLENGKETLQ
HLA_A(var.2CP) KDYIALKEDLRSWTAADMAAQTTKHKWEAAHVAEQLRAYLEGTCVEWLRRYLENGKETLQ
HLA-A*1101     KDYIALNEDLRSWTAADMAAQITKRKWEAAHAAEQQRAYLEGRCVEWLRRYLENGKETLQ
HLA A*2402     KDYIALKEDLRSWTAADMAAQITKRKWEAAHVAEQQRAYLEGTCVDGLRRYLENGKETLQ
HLA-A*3303     KDYIALNEDLRSWTAADMAAQITQRKWEAARVAEQLRAYLEGTCVEWLRRYLENGKETLQ
               :****:***::* ****  *  *:.*  * .  ** *.****  **:  ******  *::. *
                             aac3  aac4
```

Fig. 25 (continued)

```
                                                                        236
                                                                         ↓
HLA-A            RTDPPKTHMTHHPISDHEATLRCWALGFYPAEITLTWQRDGEDQTQDTELVETRPAGDGTF
HLA-B            RADPPKTHVTHHPISDHEATLRCWALGFYPAEITLTWQRDGEDQTQDTELVETRPAGDRTF
HLA-C            RAEPPKTHVTHHPLSDHEATLRCWALGFYPAEITLTWQRDGEDQTQDTELVETRPAGDGTF
HLA-A*0201       RTDAPKTHMTHHAVSDHEATLRCWALSFYPAEITLTWQRDGEDQTQDTELVETRPAGDGTF
MOUSE H2K        RTDSPKAHVTYHPRSQVDVTLRCWALGFYPADITLTWQLNGEDLTQDMELVETRPAGDGTF
HLA_A(var. 2)    RTDAPKTHMTHHAVSDHEATLRCWALSFYPAEITLTWQRDGEDQTQDTELVETRPCGDCTF
HLA_A(var. 2C)   RTDAPKTHMTHHAVSDHEATLRCWALSFYPAEITLTWQRDGEDQTQDTELVETRPCGDCTF
HLA-A(var.2CP)   RTDAPKTHMTHHAVSDHEATLRCWALSFYPAEITLTWQRDGEDQTQDTELVETRPCGDCTF
HLA-A*1101       RTDPPKTHMTHHPISDHEATLRCWALGFYPAEITLTWQRDGEDQTQDTELVETRPAGDGTF
HLA-A*2402       RTDPPKTHMTHHPISDHEATLRCWALGFYPAEITLTWQRDGEDQTQDTELVETRPAGDGTF
HLA-A*3303       RTDPPKTHMTHHAVSDHEATLRCWALSFYPAEITLTWQRDGEDQTQDTELVETRPAGDGTF
                 *::  **:*:*:*    *:  :.*******.****:****** :*** *** ********  ** **
                                                                     aac5  aac6

HLA-A            QKWAAVVVPSGEEQRYTCHVQHEGLPKPLTLRWE   (SEQ ID NO:391)
HLA-B            QKWAAVVVPSGEEQRYTCHVQHEGLPKPLTLRWE   (SEQ ID NO:392)
HLA-C            QKWAAVVVPSGQEQRYTCHMQHEGLQEPLTLSWE   (SEQ ID NO:393)
HLA-A*0201        QKWAAVVVPSGQEQRYTCHVQHEGLPKPLTLRWEP  (SEQ ID NO:53)
MOUSE H2K        QKWAAVVVPLGKEQNYTCHVHHKGLPEPLTLRW    (SEQ ID NO:311)
HLA_A(var. 2)    QKWAAVVVPSGQEQRYTCHVQHEGLPKPLTLRWE   (SEQ ID NO:394)
HLA_A(var. 2C)   QKWAAVVVPSGQEQRYTCHVQHEGLPKPLTLRWE   (SEQ ID NO:395)
HLA-A(var.2CP)   QKWAAVVVPSGQEQRYTCHVQHEGLPKPLTLRWEP  (SEQ ID NO:396)
HLA-A*1101       QKWAAVVVPSGEEQRYTCHVQHEGLPKPLTLRWEL  (SEQ ID NO:294)
HLA A*2402       QKWAAVVVPSGEEQRYTCHVQHEGLPKPLTLRWEP  (SEQ ID NO:295)
HLA-A*3303       QKWASVVVPSGQEQRYTCHVQHEGLPKPLTLRWEP  (SEQ ID NO:296)
                 ****:****  *:**.****::*:** :**** *
```

FIG. 26A

```
A*0101    GSHSMRYFFTSVSRPGRGEPRFIAVGYVDDTQFVRFDSDAASQRMEPRAPWIEQEGPEYW    60
A*0201    GSHSMRYFFTSVSRPGRGEPRFIAVGYVDDTQFVRFDSDAASQRMEPRAPWIEQEGPEYW    60
A*0301    GSHSMRYFFTSVSRPGRGEPRFIAVGYVDDTQFVRFDSDAASQRMEPRAPWIEQEGPEYW    60
A*1101    GSHSMRYFYTSVSRPGRGEPRFIAVGYVDDTQFVRFDSDAASQRMEPRAPWIEQEGPEYW    60
A*2301    GSHSMRYFSTSVSRPGRGEPRFIAVGYVDDTQFVRFDSDAASQRMEPRAPWIEQEGPEYW    60
A*2402    GSHSMRYFSTSVSRPGRGEPRFIAVGYVDDTQFVRFDSDAASQRMEPRAPWIEQEGPEYW    60
A*2407    GSHSMRYFSTSVSRPGRGEPRFIAVGYVDDTQFVRFDSDAASQRMEPRAPWIEQEGPEYW    60
A*3303    GSHSMRYFYTSVSRPGRGEPRFIAVGYVDDTQFVRFDSDAASQRMEPRAPWIEQEGPEYW    60
A*3401    GSHSMRYFYTSVSRPGRGEPRFIAVGYVDDTQFVRFDSDAASQRMEPRAPWIEQEGPEYW    60
                                                              84
A*0101    DQETRNVKAHSQTDRANLGTLRGYYNQSEAGSHTIQIMYGCDVGPDGRFLRGYRQDAYDG   120
A*0201    DQETRNVKAHSQTDRVDLGTLRGYYNQSEAGSHTVQRMYGCDVGSDWRFLRGYHQYAYDG   120
A*0301    DQETRNVKAQSQTDRVDLGTLRGYYNQSEAGSHTIQIMYGCDVGSDGRFLRGYRQDAYDG   120
A*1101    DQETRNVKAQSQTDRVDLGTLRGYYNQSEAGSHTIQIMYGCDVGPDGRFLRGYRQDAYDG   120
A*2301    DEETGKVKAHSQTDRENLRIALRYYNQSEAGSHTLQMMFGCDVGSDGRFLRGYHQYAYDG   120
A*2402    DEETGKVKAHSQTDRENLRIALRYYNQSEAGSHTLQMMFGCDVGGDGRFLRGYHQYAYDG   120
A*2407    DEETGKVKAQSQTDRENLRIALRYYNQSEAGSHTLQMMFGCDVGSDGRFLRGYHQYAYDG   120
A*3303    DRNTRNVKAHSQIDRVDLGTLRGYYNQSEAGSHTIQMMYGCDVGSDGRFLRGYQQDAYDG   120
A*3401    DRNTRKVKAQSQTDRVDLGTLRGYYNQSEAGSHTIQRMYGCDVGPDGRFLRGYQQDAYDG   120
                                   aac1    aac2
                                          139
A*0101    KDYIALNEDLRSWTAADMAAQITKRKWEAVHAAEQRRVYLEGRCVDGLRRYLENGKETLQ   180
A*0201    KDYIALKEDLRSWTAADMAAQTTKHKWEAAHVAEQLRAYLEGTCVEWLRRYLENGKETLQ   180
A*0301    KDYIALNEDLRSWTAADMAAQITKRKWEAAHEAEQLRAYLDGTCVEWLRRYLENGKETLQ   180
A*1101    KDYIALNEDLRSWTAADMAAQITKRKWEAAHAAEQQRAYLEGRCVEWLRRYLENGKETLQ   180
A*2301    KDYIALKEDLRSWTAADMAAQITKRKWEAAHVAEQLRAYLEGTCVEWLRRYLENGKETLQ   180
A*2402    KDYIALKEDLRSWTAADMAAQITKHKWEAAHVAEQQRAYLEGTCVDSLRRYLENGKETLQ   180
A*2407    KDYIALKEDLRSWTAADMAAQITKRKWEAAHVAEQQRAYLEGTCVDGLRRYLENGKETLQ   180
A*3303    KDYIALNEDLRSWTAADMAAQTTQRKWEAAKVAEQLRAYLEGTCVEWLRRYLENGKETLQ   180
A*3401    KDYIALNEDLRSWTAADMAAQITQRKWETAHEAEQWRAYLEGTCVEWLRRYLENGKETLQ   180
                              aac3    aac4
                                                               236
A*0101    RTDPPKTHMTHHPISDHEATLRCWALGFYPAEITLTWQRDGEDQTQDTELVETRPAGDGTF   241
A*0201    RTDAPKTHMTHHAVSDHEATLRCWALGFYPAEITLTWQRDGEDQTQDTELVETRPAGDGTF   241
A*0301    RTDPPKTHMTHHPISDHEATLRCWALGFYPAEITLTWQRDGEDQTQDTELVETRPAGDGTF   241
A*1101    RTDPPKTHMTHHPISDHEATLRCWALGFYPAEITLTWQRDGEDQTQDTELVETRPAGDGTF   241
A*2301    RTDPPKTHMTHHPISDHEATLRCWALGFYPAEITLTWQRDGEDQTQDTELVETRPAGDGTF   241
A*2402    RTDPPKTHMTHHPISDHEATLRCWALGFYPAEITLTWQRDGEDQTQDTELVETRPAGDGTF   241
A*2407    RTDPPKTHMTHHPISDHEATLRCWALGFYPAEITLTWQRDGEDQTQDTELVETRPAGDGTF   241
A*3303    RTDPPKTHMTHHAVSDHEATLRCWALGFYPAEITLTWQRDGEDQTQDTELVETRPAGDGTF   241
A*3401    RTDAPKTHMTHHAVSDHEATLRCWALGFYPAEITLTWQRDGEDQTQDTELVETRPAGDGTF   241
                                                          aac5    aac6
A*0101    QKWAAVVVPSGEEQRYTCHVQHEGLPKPLTLRWEL   276
A*0201    QKWAAVVVPSGQEQRYTCHVQHEGLPKPLTLRWEP   276
A*0301    QKWAAVVVPSGEEQRYTCHVQHEGLPKPLTLRWEL   276
A*1101    QKWAAVVVPSGEEQRYTCHVQHEGLPKPLTLRWEL   276
A*2301    QKWAAVVVPSGEEQRYTCHVQHEGLPKPLTLRWEP   276
A*2402    QKWAAVVVPSGEEQRYTCHVQHEGLPKPLTLRWEP   276
A*2407    QKWAAVVVPSGEEQRYTCHVQHEGLPKPLTLRWEP   276
A*3303    QKWASVVVPSGQEQRYTCHVQHEGLPKPLTLRWEP   276
A*3401    QKWASVVVPSGQEQRYTCHVQHEGLPKPLTLRWEP   276
```

FIG. 26B

(SEQ ID NO:301)

GSHSMRYFX1TSVSRPGRGEPRFIAVGYVDDTQFVRFDSDAASQX2MEPRAPWIEQEGPEYWDX3X4TX5X6X7KAX8SQX9X10RX11X12LX13X14X15X16X17YYNQSEX18GSHTX19QX20MX21GCDVGX22DX23RFLRGYX24QX25AYDGKDYIALX26EDLRSWTAADMAAQX27TX287

FIG. 27A

```
B*0702  GSHSMRYFYTSVSRPGRGEPRFISVGYVDDTQFVRFDSDAASPREEPRAPWIEQEGPEYW   60
B*0801  GSHSMRYFDTAMSRPGRGEPRFISVGYVDDTQFVRFDSDAASPREEPRAPWIEQEGPEYW   60
B*1502  GSHSMRYFYTAMSRPGRGEPRFIAVGYVDDTQFVRFDSDAASPRMAPPAPWIEQEGPEYW   60
B*3802  GSHSMRYFYTSVSRPGRGEPRFISVGYVDDTQFVRFDSDAASPREEPRAPWIEQEGPEYW   60
B*4001  GSHSMRYFHTAMSRPGRGEPRFITVGYVDDTLFVRFDSDATSPREEPRAPWIEQEGPEYW   60
B*4601  GSHSMRYFYTAMSRPGRGEPRFIAVGYVDDTQFVRFDSDAASPRMAPRAPWIEQEGPEYW   60
B*5301  GSHSMRYFYTAMSRPGRGEPRFIAVGYVDDTQFVRFDSDAASPRTEPRAPWIEQEGPEYW   60
        *******:;:***********:******* *********;***  **************

89
B*0702  DRNTQIYKAQAQTDRESLRNLRGYYNQSEAGSHTLQSMYGCDVGPDGRLLRGHDQYAYDG  120
B*0801  DRNTQIFKTNTQTDRESLRNLRGYYNQSEAGSHTLQSMYGCDVGPDGRLLRGHDQYAYDG  120
B*1502  DRNTQISKTNTQTYRESLRNLRGYYNQSEAGSHIQRMYGCDVGPDGRLLRGYDQSAYDG  120
B*3802  DRNTQICKTNTQTYRESLRTALRYYNQSEAGSHTLQRMYGCDVGPDGRLLRGHEQFAYDG  120
B*4001  DRETQISKTNTQTYRESLRNLRGYYNQSEAGSHTLQRMYGCDVGPDGRLLRGHNQYAYDG  120
B*4601  DRETQKYKRQAQTDRVSLRNLRGYYNQSEAGSHTLQRMYGCDVGPDGRLLPGHDQSAYDG  120
B*5301  DRNTQIFKTNTQTYRESLRIALRYYNQSEAGSHIQRMYGCDLGPDGRLLRGHDQSAYDG  120
        **:***  * :::** *  * ,,      ********   :*  *****:;*   ****
                                    aac1   aac2

139
B*0702  KDYIALNEDLRSWTAADTAAQITQRKWEAAREAEQRRAYLEGECVEWLRRYLENGKDKLE  180
B*0801  EDYIALNEDLRSWTAADTAAQITQRKWEAARVAEQDRAYLEGTCVEWLRRYLENGKDTLE  180
B*1502  KDYIALNEDLSSWTAADTAAQITQRKWEAAREAEQLRAYLEGLCVEWLRRYLENGKETLQ  180
B*3802  KDYIALNEDLSSWTAADTAAQITQRKWEAAPVAEQLRTYLEGTCVEWLPPYLENGKETLQ  180
B*4001  KDYIALNEDLRSWTAADTAAQISQRKLEAARVAEQLRAYLEGECVEWLRRYLENGKDKLE  180
B*4601  KDYIALNEDLSSWTAADTAAQITQRKWEAAPEAEQWRAYLEGLCVEWLRRYLENGKETLQ  180
B*5301  KDYIALNEDLSSWTAADTAAQITQRKWEAARVAEQLRAYLEGLCVEWLRRYLENGKETLQ  180
        **********,**;*******;** *** *** *;:********   ***,.*;
            aac3      aac4

236
B*0702  RADPPKTHVTHHPISDHEATLRCWALGFYPAEITLTWQRDGEDQTQDTELVETRPAGDRTF  241
B*0801  RADPPKTHVTHHPISDHEATLRCWALGFYPAEITLTWQRDGEDQTQDTELVETRPAGDRTF  241
B*1502  RADPPKTHVTHHPISDHEATLRCWALGFYPAEITLTWQRDGEDQTQDTELVETRPAGDRTF  241
B*3802  RADPPKTHVTHHPISDHEATLRCWALGFYPAEITLTWQRDGEDQTQDTELVETRPAGDRTF  241
B*4001  RADPPKTHVTHHPISDHEATLRCWALGFYPAEITLTWQRDGEDQTQDTELVETRPAGDRTF  241
B*4601  RADPPKTHVTHHPISDHEATLRCWALGFYPAEITLTWQRDGEDQTQDTELVETRPAGDRTF  241
B*5301  RADPPKTHVTHHPVSDHEATLRCWALGFYPAEITLTWQRDGEDQTQDTELVETRPAGDRTF  241
        *************:**********************************************
                                                           aac5   aac6

B*0702  QKWAAVVVPSGEEQRYTCHVQHEGLPKPLTLRWEP  276
B*0801  QKWAAVVVPSGEEQRYTCHVQHEGLPKPLTLRWEP  276
B*1502  QKWAAVVVPSGEEQRYTCHVQHEGLPKPLTLRWEP  276
B*3802  QKWAAVVVPSGEEQRYTCHVQHEGLPKPLTLRWEP  276
B*4001  QKWAAVVVPSGEEQRYTCHVQHEGLPKPLTLRWEP  276
B*4601  QKWAAVVVPSGEEQRYTCHVQHEGLPKPLTLRWEP  276
B*5301  QKWAAVVVPSGEEQRYTCHVQHEGLPKPLTLRWEP  276
        ***********************************
```

FIG. 27B

(SEQ ID NO:308)

GSHSMRYFX1TX2X3SRPGRGEPRFIX4VGYVDDTX5FVRFDSDAX6SPRX7X8PRAPWIEQEG
PEYWDRX9TQX10X11KTX12X13TQX14YX15X16NLX17X18X19X20YYNQSEAGSH**X21X
22QX23MYGCDLGPDGRLLRGHDQSAYDGKDYIALNEDLX24SWTAADTAAQIX25**Q

FIG. 28A

```
C*0102  CSHSMKYFFTSVSRPGRGEPRFISVGYVDDTQFVRFDSDAASPRGEPRAPWVEQEGPEYW   60
C*0303  GSHSMRYFYTAVSRPGRGEPRFIAVGYVDDTQFVRFDSDAASPRGEPRAPWVEQEGPEYW   60
C*0304  GSHSMRYFYTAVSRPGPGEPRFIAVGYVDDTQFVRFDSDAASPRGEPRAPWVEQEGPEYW   60
C*0401  GSHSMRYFSTSVSRPGRGEPRFIAVGYVDDTQFVRFDSDAASPRGEPREPWVEQEGPEYW   60
C*0602  CSHSMRYFDTAVSRPGRGEPRFISVGYVDDTQFVRFDSDAASPRGEPRAPWVEQEGPEYW   60
C*0701  CSHSMRYFDTAVSRPGRGEPRFISVGYVDDTQFVRFDSDAASPRGEPRAPWVEQEGPEYW   60
C*0702  CSHSMRYFDTAVSRPGRGEPRFISVGYVDDTQFVRFDSDAASPRGEPRAPWVEQEGPEYW   60
C*0801  CSHSMRYFYTAVSRPGRGEPRFIAVGYVDDTQFVRFDSDAASPRGKPRAPWVEQEGPEYW   60
C*1502  CSHSMRYFYTAVSRPGRGEPHFIAVGYVDDTQFVRFDSDAASPRGEPRAPWVEQEGPEYW   60
         ******:** *:** ******:**:********************** **********

94
C*0102  DRETQKYKRQAQTDRVSLRNLRGYYNQSEAGSHTLQWMCGCDLGPDGRLLRGYDQYAYDG  120
C*0303  DRETQKYKRQAQTDRVSLRNLRGYYNQSEARSHIIQRMYGCDVGPDGRLLRGYDQYAYDG  120
C*0304  DRETQKYKRQAQTDRVSLRNLRGYYNQSEAGSHIIQRMYGCDVGPDGRLLRGYDQYAYDG  120
C*0401  DRETQKYKRQAQADRVNLRKLRGYYNQSEDGSHTLQRMFGCDLGPDGRLLRGYNQFAYDG  120
C*0602  DRETQKYKRQAQADRVNLRKLRGYYNQSEDGSHTLQWMYGCDLGPDGRLLRGYDQSAYDG  120
C*0701  DRETQNYKRQAQADRVSLRNLRGYYNQSEDGSHTLQRMYGCDLGPDGRLLRGYDQGAYDG  120
C*0702  DRETQKYKRQAQADRVSLRNLRGYYNQSEDGSHTLQRMSGCDLGPDGRLLRGYDQSAYDG  120
C*0801  DRETQKYKRQAQTDRVSLRNLRGYYNQSEAGSHTLQRMYGCDLGPDGRLLRGYNQFAYDG  120
C*1502  DRETQNYKRQAQTDRVNLRKLRGYYNQSEAGSHIIQRMYGCDLGPDGRLLRGHDQLAYDG  120
         *****:*****:***.:*.****:******* **:;* * ***:*********;;* ****
                    aac1      aac2

139
C*0102  KDYIALNEDLRSWTAADTAAQITQRKWEAAREAEQRRAYLEGTCVEWLRRYLENGKETLQ  180
C*0303  KDYIALNEDLRSWTAADTAAQITQRKWEAAREAEQLRAYLEGLCVEWLRRYLKNGKETLQ  180
C*0304  KDYIALNEDLRSWTAADTAAQITQRKWEAAREAEQLRAYLEGLCVEWLRRYLKNGKETLQ  180
C*0401  KDYIALNEDLRSWTAADTAAQITQRKWEAAREAEQWRAYLEGTCVEWLRRYLENGKETLQ  180
C*0602  KDYIALNEDLRSWTAADTAAQITQRKWEAAPRAEQWRAYLEGTCVEWLRPYLENGKETLQ  180
C*0701  KDYIALNEDLRSWTAADTAAQITQRKLEAAPAAEQLRAYLEGTCVEWLRRYLENGKETLQ  180
C*0702  KDYIALNEDLRSWTAADTAAQITQRKLEAAPAAEQLRAYLEGTCVEWLRRYLENGKETLQ  180
C*0801  KDYIALNEDLRSWTAADTAAQITQRKWEAAKTAEQLRAYLEGTCVEWLRKYLENGKETLQ  180
C*1502  KDYIALNEDLRSWTAADTAAQITQRKWEAAREAEQLRAYLEGTCVEWLRRYLENGKETLQ  180
         ************:*****:*****  ****  *** ****** ****;***:***
                aac3  aac4
                                                               236
C*0102  RAEHPKTHVTHHPVSDHEATLRCWALGFYPAEITLTWQWDGEDQTQDTELVETRPAGDGTF  241
C*0303  RAEHPKTHVTHHPVSDHEATLRCWALGFYPAEITLTWQWDGEDQTQDTELVETRPAGDGTF  241
C*0304  RAEHPKTHVTHHPVSDHEATLRCWALGFYPAEITLTWQWDGEDQTQDTELVETRPAGDGTF  241
C*0401  RAEHPKTHVTHHPVSDHEATLRCWALGFYPAEITLTWQRDGEDQTQDTELVETRPAGDGTF  241
C*0602  RAEHPKTHVTHHPVSDHEATLRCWALGFYPAEITLTWQRDGEDQTQDTELVETRPAGDGTF  241
C*0701  RAEPPKTHVTHHPLSDHEATLRCWALGFYPAEITLTWQRDGEDQTQDTELVETRPAGDGTF  241
C*0702  RAEPPKTHVTHHPLSDHEATLRCWALGFYPAEITLTWQRDGEDQTQDTELVETRPAGDGTF  241
C*0801  RAEHPKTHVTHHPVSDHEATLRCWALGFYPAEITLTWQRDGEDQTQDTELVETRPAGDGTF  241
C*1502  RAEHPKTHVTHHPVSDHEATLRCWALGFYPAEITLTWQRDGEDQTQDTELVETRPAGDGTF  241
         *** ************;********************** ***************:*****
                                                          aac5  aac6

C*0102  QKWAAVVVPSGEEQRYTCHVQHEGLPEPLTLRWEP  276
C*0303  QKWAAVVVPSGEEQRYTCHVQHEGLPEPLTLRWEP  276
C*0304  QKWAAVVVPSGEEQRYTCHVQHEGLPEPLTLRWEP  276
C*0401  QKWAAVVVPSGEEQRYTCHVQHEGLPEPLTLRWKP  276
C*0602  QKWAAVVVPSGEEQRYTCHVQHEGLPEPLTLRWEP  276
C*0701  QKWAAVVVPSGEEQRYTCHVQHEGLQEPLTLSWEP  276
C*0702  QKWAAVVVPSGQEQRYTCHVQHEGLQEPLTLSWEP  276
C*0801  QKWAAVVVPSGEEQRYTCHVQHEGLPEPLTLRWGP  276
C*1502  QKWAAVVVPSGEEQRYTCHVQHEGLPEPLTLRWEP  276
         ******;****:********;***** ***** *
```

FIG. 28B

(SEQ ID NO:310)

X1SHSMX2YFX3TAVSX4PGRGEPX5FIX6VGYVDDTQFVX7FDSDAASPRGEPRX8PWVEQEG
PEYWDRETQX9YKRQAQX10DRVX11LRX12LRGYYNQSEX13X14SHX15X16QX17MX18GC
DX19GPDGRLLRGX20X21QX22AYDGKDYIALNEDLRSWTAADTAAQITQRKX23EAARX24A
EQX25RAYLEGX26CVEWLRRYLX27NGKX28TLQRAEX29PKTHVTHHPX30SDHEATLRCWA
LGFYPAEITLTWQX31DGEDQTQDTELVETRPAGDGTFQKWAAVX32VPSGX33EQRYTCHX34
QHEGLX35EPLTLX36WX37P

X1 is C or G; X2 is R or K; X3 is F, Y, S, or D; X4 is R or W;
X5 is H or R; X6 is A or S; X7 is Q or R; X8 is A or E; X9 is N
or K; X10 is T or A; X11 is S or N; X12 is N or K; X13 is A or D;
X14 is G or R; X15 is T or I; X16 is L or I; X17 is W or R; X18
is C, Y, F, or S; X19 is L, or V; X20 is Y or H; X21 is D or N;
X22 is Y, F, S, or L; X23 is L or W; X24 is E, A, Or T; X25 is
R, L, or W; X26 is L or T; X27 is E OR K; X28 is E or K; X29 is
H or P; X30 is R or V; X31 is W or R; X32 is V or M; X33 is E or
Q; X34 is M or V; X35 is P or Q; X36 is R or S; and X37 is P or
G.

FIG. 29

| |
|---|
| HLA-E<br>GSHSLKYFHT SVSRPGRGEP RFISVGYVDD TQFVRFDNDA ASPRMVPRAP<br>WMEQEGSEYW DRETRSARDT AQIFRVNLRT LRGYYNQSX1A GSHTLQWMHG<br>CELGPDX2RFL RGYEQFAYDG KDYLTLNEDL RSWTAVDTAA QISEQKSNDA<br>SEAEHQX3X4YL EDTCVEWLHK YLEKGKETLL HLEPPKTHVT HHPISDHEAT<br>LRCWALGFYP AEITLTWQQD GEGHTQDTEL VETRPAGDGT FQKWAAVVVP<br>SGEEX5RYTCH VQHEGLX6EPV TLRWKPASQP TIPI<br><br>X1= K or E; X2= R or G; X3= R or G; X4= A or V; X5= Q or P; and X6= P or S |
| Encompasses: HLA-E*0101 (HLA-E*01:01:01:01); HLA-E*01:03(HLA-E*01:03:01:01); HLA-E*01:04; HLA-E*01:05; HLA-E*01:06; HLA-E*01:07; HLA-E*01:09; HLA-E*01:10 |
| HLA-F<br>GSHSLRX1FST AVSRPGRGEP RYIAVEYVDD TQFLRFDSDA AIPRMEPREX2<br>WVEQEGPQYW EWTTGYAKAN AQTDRVALRN LLRRYNQSEA GSHTLQGMNG<br>CDMGPDGRLL RGYIIQIIAYDG KDYISLNEDL RSWTAADTVA QITQRFYEAE<br>EYAEEFRTYL EGECLELLRR YLENGKETLQ RADPPKAHVA HHPISDHEAT<br>LRCWALGFYP AEITLTWQRD GEEQTQDTEL VETRPAGDGT FQKWAAVVVP<br>X3GEEQRYTCH VQHEGLPQPL ILRWEQSX4QP TIPI<br><br>X1= Y or F; X2= P or Q; X3= S or P; and X4= P or L |
| Encompasses: HLA-F*0101 (HLA-F*01:01:01:01); HLA-F*01:02; HLA-F*01:03(HLA-F*01:03:01:01); HLA-F*01:04; HLA-F*01:05; HLA-F*01:06; |
| HLA-G<br>GSHSMRYFSA AVX1RPGRGEP RFIAMGX2VDD X3QFX4RFDSDS ACPRMEPRAP<br>WVEX5EGPEYW EEETRNTKAH AQTDRMNLQT X6RGYYNQSEA SSHTLQWMIX7<br>CDLX8X9DGRLX10 RGYEQYAYDG KDYLALNEDL RSWTAADTAA QISKRKCEAA<br>NVAEQRRAX11L EGTCVEWLX12R X13LENGKEX14LQ RADPX15KTHVT HHPVFDYEAT<br>LRCWALGFYP AEIILTWQX16D GEDQTQDVEL VETRPAGDGT FQKWAAVVVP<br>SGEEQRYX17CH VQHEGLPEPL MLRWX18QSSLP TIPI<br><br>X1= S or F; X2= Y or H; X3= T, S, or M; X4= L or V; X5= Q or R; X6= P or L; X7= G or D; X8= G or V; X9= S or C; X10= L or I; X11= Y or H; X12= H or R; X13= Y or H; X14= M or T; X15= P or A; X16= R, W, or Q; X17= T or M; X18= K or E; |
| Encompasses: HLA-G*0101 (HLA-G*01:01:01:01); HLA-G*01:02; HLA-G*01:03(HLA-G*01:03:01:01); HLA-G*01:04 (HLA-G*01:04:01:01); HLA-G*01:06; HLA-G*01:07; HLA-G*01:08; HLA-G*01:09: HLA-G*01:10; HLA-G*01:10; HLA-G*01:11; HLA-G*01:12; HLA-G*01:14; HLA-G*01:15; HLA-G*01:16; HLA-G*01:17; HLA-G*01:18: HLA-G*01:19; HLA-G*01:20; HLA-G*01:22 |

FIG. 30

```
HLA-A   GSHSMRYFXTSVSRPGRGEPRFIAVGYVDDTQFVRFDSDAASQXMEPRAPWIEQEGPEYW  60
HLA-B   GSHSMRYFXTXXSRPGRGEPRFIXVGYVDDTXFVRFDSDAXSPRXXPRAPWIEQEGPEYW  60
HLA C   XSHSMXYFXTAVSXPGRGEPXFIXVGYVDDTQFVXFDSDAASPRGEPRXPWVEQEGPEYW  60
HLA-E   GSHSLKYFHTSVSRPGRGEPRFISVGYVDDTQFVRFDNDAASPRMVPRAPWMEQEGSEYW  60
HLA-F   GSHSLRXFSTAVSRPGRGEPRYIAVEYVDDTQFLRFDSDAAIPRMEPREXWVEQEGPQYW  60
HLA-G   GSHSMRYFSAAVXRPGRGEPRFIAMGXVDDXQFXRFDSDSACPRMEPRAPWVEXEGPEYW  60
        ***:    *  :    ****** :*  :  *** *  **.*:      **  *:* ** :**

84
HLA-A   DXXTXXXKAXSQXXRXXLXXXXXYNQSEKGSHTXQXMXGCDVGXDXRFLRGYXQXAYDG  120
HLA-B   DRXTQXXKTXXTQXYXXNLXXXXYNQSEAGSHXXQXMYGCDLGPDGRLLRGHDQSAYDG  120
HLA-C   DRETQXYKRQAQXDRVXLRXLRGYYNQSEXXSHXXQXMXGCDXGPDGRLLRGXXQXAYDG  120
HLA-E   DRETRSARDTAQIFRVNLRTLRGYYNQSXAGSHTLQWMHGCELGPDXRFLRGYEQFAYDG  120
HLA-F   EWTTGYAKANAQTDRVALRNLLHRYNQSEAGSHTLQGMNGCDMGPDGRLLRGYHQHAYDG  120
HLA-G   EEETRNTKAHAQTDRMNLQTXRGYYNQSEASSHTLQWMLXCDLXXDGRLXRGYEQYAYDG  120
        :   *    :        :****  **   *   * *:  * *: **  * * ****
                                 aac1      aac2

139
HLA-A   KDYIALXEDLRSWTAADMAAQXTXXKWEXXXEAEQXRXYLXGXCVXXLRRYLENGKETLQ  180
HLA-B   KDYIALNEDLXSWTAADTAAQIXQRKXEAARXAEQXRXYLEGXCVEWLRRYLENGKXXLX  180
HLA-C   KDYIALNEDLRSWTAADTAAQITQRKXEAARXAEQXRAYLEGXCVEWLRRYLXNGKXTLQ  180
HLA-E   KDYLTLNEDLRSWTAVDTAAQISEQKSNDASEAEHQXXYLEDTCVEWLHKYLEKGKETLL  180
HLA-F   KDYISLNEDLRSWTAADTVAQITQRFYEAEEYAEEFRTYLEGECLELLRRYLENGKETLQ  180
HLA-G   KDYLALNEDLRSWTAADTAAQISKRKCEAANVAEQRRAXLEGTCVEWLXRXLENGKEXLQ  180
        ***::*  *** ****.* :*:  * :    **.     * . *: *  : *:**   *
                           aac3      aac4

236
HLA-A   RTDXPKTHMTHHXXSDHEATLRCWALXFYPAEITLTWQRDGEDQTQDTELVETRPAGDGTF  241
HLA-B   RADPPKTHVTHHPXSDHEATLRCWALGFYPAEITLTWQRDGEDQTQDTELVETRPAGDRTF  241
HLA-C   RAEXPKTHVTHHPXSDHEATLRCWALGFYPAEITLTWQXDGEDQTQDTELVETRPAGDGTF  241
HLA-E   HLEPPKTHVTHHPISDHEATLRCWALGFYPAEITLTWQQDGEGHTQDTELVETRPAGDGTF  241
HLA-F   RADPPKAHVAHHPISDHEATLRCWALGFYPAEITLTWQRDGEEQTQDTELVETRPAGDGTF  241
HLA-G   RADPXKTHVTHHPVFDYEATLRCWALGFYPAEIILTWQXDGEDQTQDVELVETRPAGDGTF  241
        :  :    *:*:::**    *:********* ****** ***  ***  :***.*******:** **
                                                              ac5  aac6

HLA-A   QKWAXVVVPSGXEQRYTCHVQHECLPKPLTLRWEX--------  276
HLA-B   QKWAAVVVPSGEEQRYTCHVQHEGLPKPLTLRWEP--------  276
HLA-C   QKWAAVXVPSGXEQRYTCHXQHEGLXEPLTLXWP--------  276
HLA-E   QKWAAVVVPSGEEXRYTCHVQHEGLXEPVTLRWKPASQPTIPI  284
HLA-F   QKWAAVVVPXGEEQRYTCHVQHEGLPQPLILRWEQSXQPTIPI  284
HLA G   QKWAAVVVPSGEEQRYXCHVQHEGLPEPLMLRWXQSSLPTIPI  284
        ****  *  ** * *  ** *****  :*:  * *
```

T-CELL MODULATORY MULTIMERIC POLYPEPTIDES COMPRISING REDUCED-AFFINITY IMMUNOMODULATORY POLYPEPTIDES

CROSS-REFERENCE

This application is a continuation of PCT/US2019/012688, filed Jan. 8, 2019, which claims the benefit of U.S. Provisional Patent Application No. 62/615,225, filed Jan. 9, 2018, U.S. Provisional Patent Application No. 62/615,253, filed Jan. 9, 2018, U.S. Provisional Patent Application No. 62/713,408, filed Aug. 1, 2018, U.S. Provisional Patent Application No. 62/782,109, filed Dec. 19, 2018, and U.S. Provisional Patent Application No. 62/782,214, filed Dec. 19, 2018, each of which applications is incorporated herein by reference in its entirety.

INCORPORATION BY REFERENCE OF SEQUENCE LISTING PROVIDED AS A TEXT FILE

A Sequence Listing is provided herewith as a text file, "CUEB-112WO_SEQUENCE_LISTING_ST25.txt" created on Jan. 8, 2019 and having a size of 657 KB. The contents of the text file are incorporated by reference herein in their entirety.

INTRODUCTION

An adaptive immune response involves the engagement of the T cell receptor (TCR), present on the surface of a T cell, with a small peptide antigen non-covalently presented on the surface of an antigen presenting cell (APC) by a major histocompatibility complex (MHC; also referred to in humans as a human leukocyte antigen (HLA) complex). This engagement represents the immune system's targeting mechanism and is a requisite molecular interaction for T cell modulation (activation or inhibition) and effector function. Following epitope-specific cell targeting, the targeted T cells are activated through engagement of costimulatory proteins found on the APC with counterpart costimulatory proteins the T cells. Both signals—epitope/TCR binding and engagement of APC costimulatory proteins with T cell costimulatory proteins—are required to drive T cell specificity and activation or inhibition. The TCR is specific for a given epitope; however, the costimulatory protein not epitope specific and instead is generally expressed on all T cells or on large T cell subsets.

SUMMARY

The present disclosure provides T-cell modulatory multimeric polypeptides that comprise an immunomodulatory polypeptide that exhibits reduced binding affinity to a cognate co-immunomodulatory polypeptide. A T-cell modulatory multimeric polypeptide is useful for modulating the activity of a T cell, and for modulating an immune response in an individual.

BRIEF DESCRIPTION OF THE DRAWINGS

FIG. 2A-2F are schematic depictions of various TMMPs of the present disclosure.

FIG. 3A-3F are schematic depictions of various disulfide-linked TMMPs of the present disclosure.

FIG. 4A-4G provide amino acid sequences of hepatitis B virus polypeptides (SEQ ID NOs:400-406).

FIG. 5A-5G provide amino acid sequences of immunoglobulin Fc polypeptides (SEQ ID NOs:204-215).

FIG. 6A-6C provide amino acid sequences of human leukocyte antigen (HLA) Class I heavy chain polypeptides (SEQ ID NOs:216-218). Signal sequences are underlined.

FIG. 7 provides a multiple amino acid sequence alignment of beta-2 microglobulin (β2M) precursors (i.e., including the leader sequence) from *Homo sapiens* (NP_004039.1; SEQ ID NO:49), *Pan troglodytes* (NP_001009066.1; SEQ ID NO:49), *Macaca mulatta* (NP_001040602.1; SEQ ID NO:50), *Bos taurus* (NP_776318.1; SEQ ID NO:51) and *Mus musculus* (NP_033865.2; SEQ ID NO:52). Amino acids 1-20 are a signal peptide.

FIG. 8A-8K provide amino acid sequences of examples of suitable HLA heavy chains (SEQ ID NOs: 53, 225-234).

FIGS. 11A-16D provide nucleotide sequences encoding polypeptide chains of T-cell modulatory multimeric polypeptide of the present disclosure, as well as amino acid sequences of the T-cell modulatory multimeric polypeptides (SEQ ID NOs:245-267).

FIGS. 17A-21D provide nucleotide sequences encoding polypeptide chains of T-cell modulatory multimeric polypeptide of the present disclosure, as well as amino acid sequences of the T-cell modulatory multimeric polypeptides (SEQ ID NOs:268-287).

FIGS. 22A and 22B provide amino acid sequences of non-limiting examples of polypeptides comprising HLA-A heavy chain, which polypeptides can be included in a T-cell modulatory multimeric polypeptide of the present disclosure. FIG. 22A: SEQ ID NO:359; FIG. 22B: SEQ ID NO:360.

FIG. 23A-23E provide amino acid sequences of non-limiting examples of polypeptides comprising β2M, which polypeptides can be included in a T-cell modulatory multimeric polypeptide of the present disclosure. The polypeptides of FIGS. 23A-23E correspond to SEQ ID NOs.:361-365, respectively; and the epitopes of FIGS. 23A-23E correspond to SEQ ID NOs:315-317, 238, and 314, respectively.

FIG. 24A-24C provide amino acid sequences of full-length human HLA heavy chains of alleles A*0101 (SEQ ID NO:216), A*1101 (SEQ ID NO:294), A*2402 (SEQ ID NO:295), and A*3303 (SEQ ID NO:296) (FIG. 24A); full-length human HLA heavy chain of allele B*0702 (FIG. 24B) (SEQ ID NO:217); and a full-length human HLA-C heavy chain (FIG. 24C) (SEQ ID NO:218).

FIG. 25 provides an alignment of eleven mature MHC class I heavy chain peptide sequences without their leader sequences or transmembrane domains. Top to bottom: SEQ ID NO:391, SEQ ID NO:392, SEQ ID NO:393, SEQ ID NO:53, SEQ ID NO:311, SEQ ID NO:394, SEQ ID NO:395, SEQ ID NO:396, SEQ ID NO:294. SEQ ID NO:295, SEQ ID NO:296.

FIG. 26A-26B provide an alignment of HLA-A heavy chain amino acid sequences (FIG. 26A; SEQ ID NOs:366-374, respectively) and a consensus sequence (FIG. 26B; SEQ ID NO:301).

FIG. 27A-27B provide an alignment of HLA-B heavy chain amino acid sequences (FIG. 27A; SEQ ID NOs:375-381, respectively) and a consensus sequence (FIG. 27B; SEQ ID NO:308).

FIG. 28A-28B provide an alignment of HLA-C heavy chain amino acid sequences (FIG. 28A; SEQ ID NOs:382-390, respectively) and a consensus sequence (FIG. 28B; SEQ ID NO:310).

FIG. 29 provides a consensus amino acid sequence for each of HLA-E (SEQ ID NO:397), -F (SEQ ID NO:398), and -G (SEQ ID NO:399) heavy chains. Variable amino acid (aa) positions are indicated as "X" residues sequentially numbered; the locations of amino acids 84, 139, and 236 are double underlined.

FIG. 30 provides an alignment of consensus amino acid sequences for HLA-A (SEQ ID NO:201), -B (SEQ ID NO:308), -C (SEQ ID NO:310), -E (SEQ ID NO:397), -F (SEQ ID NO:398), and -G (SEQ ID NO:399).

DEFINITIONS

Figure 1:
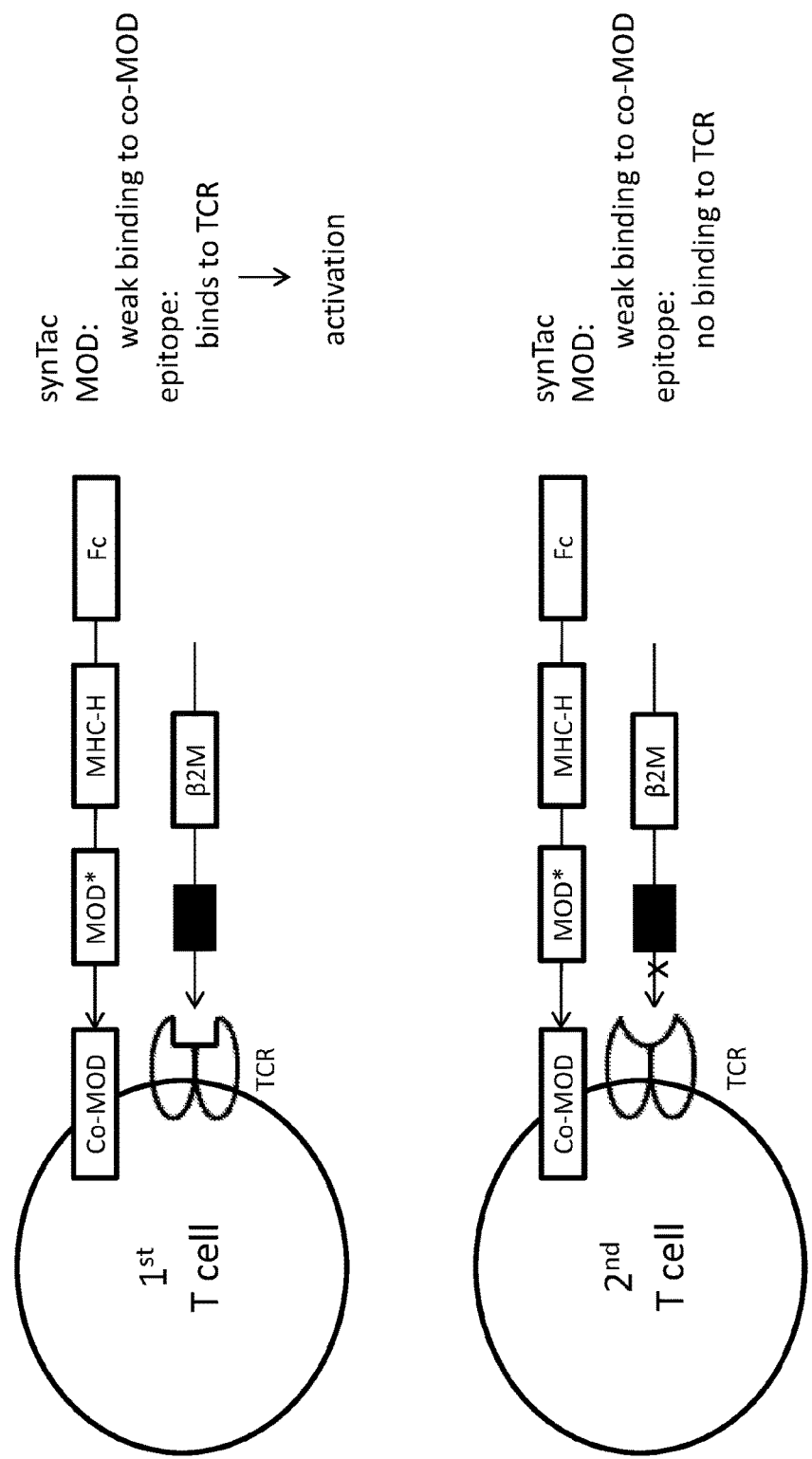
FIG. 1 depicts preferential activation of an epitope-specific T cell to an epitope non-specific T-cell by a T-cell modulatory multimeric polypeptide of the present disclosure.
Figure 2D:
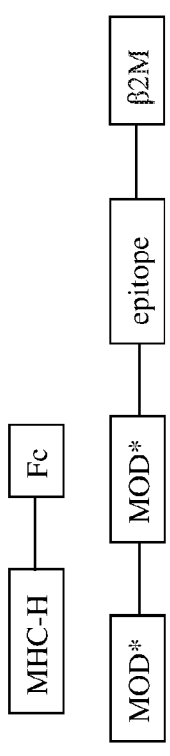
Figure 2E:
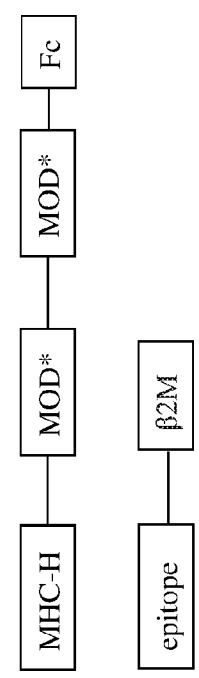
Figure 2F:
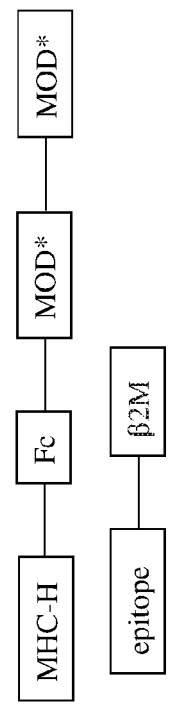

The terms "polynucleotide" and "nucleic acid," used interchangeably herein, refer to a polymeric form of nucleotides of any length, either ribonucleotides or deoxyribonucleotides. Thus, this term includes, hut is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence identity can be determined in a number of different ways. To determine sequence identity, sequences can be aligned using various convenient methods and computer programs (e.g., BLAST, T-COFFEE, MUSCLE, MAFFT, etc.), available over the world wide web at sites including ncbi.nlm.nili.gov/BLAST, ebi.ac.uk/Tools/msa/tcoffee/, ebi.ac.uk/Tools/msa/muscle/, mafft.cbrc.jp/alignment/software/. See, e.g., Altschul et al. (1990), J. Mol. Bioi. 215:403-10.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide containing side chains consisting of asparagine and glutamine; a group of amino acids having aromatic side chains consists of phenylalanine, tyrosine, and tryptophan; a group of amino acids having basic side chains consists of lysine, arginine, and histidine; a group of amino acids having acidic side chains consists of glutamate and aspartate; and a group of amino acids having sulfur containing side chains consists of cysteine and methionine. Exemplary conservative amino acid substitution groups are: valine-leucine-isoleucine, phenylalanine-tyrosine, lysine-arginine, alanine-valine-glycine, and asparagine-glutamine The term "immunological synapse" or "immune synapse" as used herein generally refers to the natural interface between two interacting immune cells of an adaptive immune response including, e.g., the interface between an antigen-presenting cell (APC) or target cell and an effector cell, e.g., a lymphocyte, an effector T cell, a natural killer cell, and the like. An immunological synapse between an APC and a T cell is generally initiated by the interaction of a T cell antigen receptor and major histocompatibility complex molecules, e.g., as described in Bromley et al., Annu Rev Immunol. 2001;19:375-96; the disclosure of which is incorporated herein by reference in its entirety.

"T cell" includes all types of immune cells expressing CD3, including T-helper cells (CD4$^+$ cells), cytotoxic T-cells (CD8$^+$ cells), T-regulatory cells (Treg), and NK-T cells.

The term "immunomodulatory polypeptide" (also referred to as a "co-stimulatory polypeptide"), as used herein, includes a polypeptide on an antigen presenting cell (APC) (e.g., a dendritic cell, a B cell, and the like) that specifically binds a cognate co-immunomodulatory polypeptide on a T cell, thereby providing a signal which, in addition to the primary signal provided by, for instance, binding of a TCR/CD3 complex with a major histocompatibility complex (MHC) polypeptide loaded with peptide, mediates a T cell response, including, but not limited to, proliferation, activation, differentiation, and the like. An immunomodulatory polypeptide can include, but is not limited to, CD7, B7-1 (CD80), B7-2 (CD86), PD-L1, PD-L2, 4-1BBL, OX40L, Fas ligand (FasL), inducible costimulatory ligand (ICOS-L), intercellular adhesion molecule (ICAM), CD30L, CD40, CD70, CD83, HLA-G, MICA, MICB, HVEM, lymphotoxin beta receptor, 3/TR6, ILT3, ILT4, HVEM, an agonist or antibody that binds Toll ligand receptor and a ligand that specifically binds with B7-H3.

As noted above, an "immunomodulatory polypeptide" (also referred to herein as a "MOD") specifically binds a cognate co-immunomodulatory polypeptide on a T cell.

An "immunomodulatory domain" ("MOD") of a T-cell modulatory multimeric polypeptide of the present disclosure binds a cognate co-immunomodulatory polypeptide, which may be present on a target T cell.

"Heterologous," as used herein, means a nucleotide or polypeptide that is not found in the native nucleic acid or protein, respectively.

"Recombinant," as used herein, means that a particular nucleic acid (DNA or RNA) is the product of various combinations of cloning, restriction, polymerase chain reaction (PCR) and/or ligation steps resulting in a construct having a structural coding or non-coding sequence distinguishable from endogenous nucleic acids found in natural systems. DNA sequences encoding polypeptides can be assembled from cDNA fragments or from a series of synthetic oligonucleotides, to provide a synthetic nucleic acid which is capable of being expressed from a recombinant transcriptional unit contained in a cell or in a cell-free transcription and translation system.

The terms "recombinant expression vector," or "DNA construct" are used interchangeably herein to refer to a DNA molecule comprising a vector and one insert. Recombinant expression vectors are usually generated for the purpose of expressing and/or propagating the insert(s), or for the construction of other recombinant nucleotide sequences. The insert(s) may or may not be operably linked to a promoter sequence and may or may not be operably linked to DNA regulatory sequences.

As used herein, the term "affinity" refers to the equilibrium constant for the reversible binding of two agents (e.g., an antibody and an antigen) and is expressed as a dissociation constant ($K_D$). Affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, at least 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1,000-fold greater, or more, than the affinity of an antibody for unrelated amino acid sequences. Affinity of an antibody to a target protein can be, for example, from about 100 nanomolar (nM) to about 0.1 nM, from about 100 nM to about 1 picomolar (pM), or from about 100 nM to about 1 femtomolar (fM) or more. As used herein, the term "avidity" refers to the resistance of a complex of two or more agents to dissociation after dilution. The terms "immunoreactive" and "preferentially binds" are used interchangeably herein with respect to antibodies and/or antigen-binding fragments.

The term "binding" refers to a direct association between two molecules, due to, for example, covalent, electrostatic, hydrophobic, and ionic and/or hydrogen-bond interactions, including interactions such as salt bridges and water bridges. Specific binding" generally refers to binding with an affinity of at least about $10^{-7}$M or greater, e.g., $5\times10^{-7}$M, $10^{-8}$M, $5\times10^{-8}$M, and greater. "Non-specific binding" generally refers to binding with an affinity of less than about $10^{-7}$M (e.g., binding with an affinity of $10^{-6}$ M, $10^{-5}$M, $10^{-4}$M). However, in some contexts, e.g., binding between a TCR and a peptide/MHC complex, "specific binding" can be in the range of from 1 μM to 100 μM, or from 100 μM to 1 mM.

The term "binding," as used herein (e.g. with reference to binding of a T-cell modulatory multimeric polypeptide to a polypeptide (e.g., a T-cell receptor) on a T cell), refers to a non-covalent interaction between two molecules. Non-covalent binding refers to a direct association between two molecules, due to, for example, electrostatic, hydrophobic, ionic, and/or hydrogen-bond interactions, including interactions such as salt bridges and water bridges. Non-covalent binding interactions are generally characterized by a dissociation constant ($K_D$) of less than $10^{-6}$ M, less than $10^{-7}$ M, less than $10^{-8}$ M, less than $10^{-9}$ M, less than $10^{-10}$ M, less than $10^{-11}$ M, less than $10^{-12}$ M, less than $10^{-13}$ M, less than $10^{-14}$ M. or less than $10^{-15}$ M. "Affinity" refers to the strength of non-covalent binding, increased binding affinity being correlated with a lower $K_D$. "Specific binding" generally refers to binding with an affinity of at least about $10^{-7}$ M or greater, e.g., $5\times10^{-7}$ M, $10^{-8}$ M, $5\times10^{-8}$ M, 10−9 M, and greater. "Non-specific binding" generally refers to binding (e.g., the binding of a ligand to a moiety other than its designated binding site or receptor) with an affinity of less than about $10^7$ M (e.g., binding with an affinity of $10^{-6}$ M, $10^{-5}$ M, $10^{-4}$ M). However, in some contexts, e.g., binding between a TCR and a peptide/MHC complex, "specific binding" can be in the range of from 1 μM to 100 μM, or from 100 μM to 1 mM. "Covalent binding" or "covalent bond," as used herein, refers to the formation of one or more covalent chemical binds between two different molecules.

The terms "treatment", "treating" and the like are used herein to generally mean obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment" as used herein covers any treatment of a disease or symptom in a mammal, and includes: (a) preventing the disease or symptom from occurring in a subject which may be predisposed to acquiring the disease or symptom but has not yet been diagnosed as having it; (b) inhibiting the disease or symptom, i.e., arresting its development; or (c) relieving the disease, i.e., causing regression of the disease. The therapeutic agent may be administered before, during or after the onset of disease or injury. The treatment of ongoing disease, where the treatment stabilizes or reduces the undesirable clinical symptoms of the patient, is of particular interest. Such treatment is desirably performed prior to complete loss of function in the affected tissues. The subject therapy will desirably be administered during the symptomatic stage of the disease, and in some cases after the symptomatic stage of the disease.

The terms "individual," "subject," "host," and "patient," are used interchangeably herein and refer to any mammalian subject for whom diagnosis, treatment, or therapy is desired. Mammals include, e.g., humans, non-human primates, rodents (e.g., rats; mice), lagomorphs (e.g., rabbits), ungulates (e.g., cows, sheep, pigs, horses, goats, and the like), etc.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "multimeric T-cell modulatory polypeptide" (also referred to herein as a "T-cell modulatory multimeric polypeptide," or "TMMP") includes a plurality of such polypeptides and reference to "the immunomodulatory polypeptide" includes reference to one or more immunomodulatory polypeptides and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides T-cell modulatory multimeric polypeptides that comprise an immunomodulatory polypeptide that exhibits reduced binding affinity to a cognate co-immunomodulatory polypeptide. A T-cell modulatory multimeric polypeptide (TMMP) of the present disclosure is useful for modulating the activity of a T cell, and for modulating an immune response in an individual.

T-Cell Modulatory Multimeric Polypeptides

The present disclosure provides a TMMP comprising: a) a first polypeptide; and b) a second polypeptide, wherein the multimeric polypeptide comprises an epitope; a first major histocompatibility complex (MHC) polypeptide; a second MHC polypeptide; one or more immunomodulatory polypeptides; and optionally an immunoglobulin (Ig) Fc polypeptide or a non-Ig scaffold. The present disclosure provides a TMMP, wherein the TMMP is a heterodimer comprising: a) a first polypeptide comprising a first MHC polypeptide; and b) a second polypeptide comprising a second MHC polypeptide, wherein the first polypeptide or the second polypeptide comprises an epitope; wherein the first polypeptide and/or the second polypeptide comprises one or more immunomodulatory polypeptides that can be the same or different; and wherein the first polypeptide or the second polypeptide optionally comprises an Ig Fc polypeptide or a non-Ig scaffold. A TMMP of the present disclosure is also referred to herein as a "multimeric T-cell modulatory polypeptide," "a multimeric polypeptide of the present disclosure" or a "synTac."

The present disclosure provides a TMMP comprising a heterodimeric polypeptide comprising: a) a first polypeptide comprising: i) a peptide epitope; and ii) a first MHC polypeptide; b) a second polypeptide comprising a second MHC polypeptide; and c) at least one immunomodulatory polypeptide, where the first and/or the second polypeptide comprises the at least one (i.e., one or more) immunomodulatory polypeptide. Optionally, the first or the second polypeptide comprises an Ig Fc polypeptide or a non-Ig scaffold. At least one of the one or more immunomodulatory polypeptides is a variant immunomodulatory polypeptide that exhibits reduced affinity to a cognate co-immunomodulatory polypeptide compared to the affinity of a corresponding wild-type immunomodulatory polypeptide for the cognate co-immunomodulatory polypeptide. The epitope present in a TMMP of the present disclosure binds to a T-cell receptor (TCR) on a T cell with an affinity of at least 100 μM (e.g., at least 10 μM, at least 1 μM, at least 100 nM, at least 10 nM, or at least 1 nM). A T-cell modulatory multimeric polypeptide of the present disclosure binds to a first T cell with an affinity that is at least 25% higher than the affinity with which the TMMP binds a second T cell, where the first T cell expresses on its surface the cognate co-immunomodulatory polypeptide and a TCR that binds the epitope with an affinity of at least 100 μM, and where the second T cell expresses on its surface the cognate co-immunomodulatory polypeptide but does not express on its surface a TCR that binds the epitope with an affinity of at least 100 μM (e.g., at least 10 μM, at least 1 μM, at least 100 nM, at least 10 nM, or at least 1 nM).

The present disclosure provides a TMMP comprising a heterodimeric polypeptide comprising: a) a first polypeptide comprising: i) a peptide epitope; and ii) a first MHC polypeptide; b) a second polypeptide comprising a second MHC polypeptide; and c) at least one immunomodulatory polypeptide, where the first and/or the second polypeptide comprises the at least one (i.e., one or more) immunomodulatory polypeptide. Optionally, the first or the second polypeptide comprises an Ig Fc polypeptide or a non-Ig scaffold. At least one of the one or more immunomodulatory polypeptides is a variant immunomodulatory polypeptide that exhibits reduced affinity to a cognate co-immunomodulatory polypeptide compared to the affinity of a corresponding wild-type immunomodulatory polypeptide for the cognate co-immunomodulatory polypeptide. The epitope present in a TMMP of the present disclosure binds to a TCR on a T cell with an affinity of at least 100 μM (e.g., at least 10 μM, at least 1 μM, at least 100 nM, at least 10 nM, or at least 1 nM). A TMMP of the present disclosure binds to a first T cell with an affinity that is at least 25% higher than the affinity with which the TMMP binds a second T cell, where the first T cell expresses on its surface the cognate co-immunomodulatory polypeptide and a TCR that binds the epitope with an affinity of at least 100 μM, and where the second T cell expresses on its surface the cognate co-immunomodulatory polypeptide but does not express on its surface a TCR that binds the epitope with an affinity of at least 100 μM (e.g., at least 10 μM, at least 1 μM, at least 100 nM, at least 10 nM, or at least 1 nM).

The present disclosure provides a TMMP comprising: a) a first polypeptide comprising, in order from N-terminus to C-terminus: i) an epitope; ii) a first MHC polypeptide; and b) a second polypeptide comprising, in order from N-terminus to C-terminus: i) a second MHC polypeptide; and ii) optionally an Ig Fc polypeptide or a non-Ig scaffold. A TMMP of the present disclosure comprises one or more immunomodulatory polypeptides, wherein at least one of the one or more immunomodulatory polypeptides is: A) at the C-terminus of the first polypeptide; B) at the N-terminus of the second polypeptide; C) at the C-terminus of the second polypeptide; or D) at the C-terminus of the first polypeptide and at the N-terminus of the second polypeptide. At least one of the one or more immunomodulatory polypeptides is a variant immunomodulatory polypeptide that exhibits reduced affinity to a cognate co-immunomodulatory polypeptide compared to the affinity of a corresponding wild-type immunomodulatory polypeptide for the cognate coimmunomodulatory polypeptide. The epitope present in a TMMP of the present disclosure binds to a T-cell receptor (TCR) on a T cell with an affinity of at least 100 μM (e.g., at least 10 μM, at least 1 μM, at least 100 nM, at least 10 nM, or at least 1 nM). A T-cell modulatory multimeric polypeptide of the present disclosure binds to a first T cell with an affinity that is at least 25% higher than the affinity with which the TMMP binds a second T cell, where the first T cell expresses on its surface the cognate co-immunomodulatory polypeptide and a TCR that binds the epitope with an affinity of at least 100 μM, and where the second T cell expresses on its surface the cognate co-immunomodulatory polypeptide but does not express on its surface a TCR that binds the epitope with an affinity of at least 100 μM (e.g., at least 10 μM, at least 1 μM, at least 100 nM, at least 10 nM, or at least 1 nM).

In some cases, the epitope present in a TMMP of the present disclosure binds to a TCR on a T cell with an affinity of from about $10^{-4}$ M to about $5\times10^{-4}$ M, from about $5\times10^{-4}$ M to about $10^{-5}$ M, from about $10^{-5}$ M to $5\times10^{-5}$ M, from about $5\times10^{-5}$ M to $10^{-6}$ M, from about $10^{-6}$ M to about $5\times10^{-6}$ M, from about $5\times10^{-6}$ M to about $10^{-7}$ M, from about $10^{-7}$ M to about $5\times10^{-7}$ M, from about $5\times10^{-7}$ M to about $10^{-8}$ M, or from about $10^{-8}$ M to about $10^{-9}$ M. Expressed another way, in some cases, the epitope present in a TMMP of the present disclosure hinds to a TCR on a T cell with an affinity of from about 1 nM to about 5 nM, from about 5 nM to about 10 nM, from about 10 nM to about 50 nM, from about 50 nM to about 100 nM, from about 0.1 μM to about 0.5 μM, from about 0.5 μM to about 1 μM, from about 1 μM to about 5 μM, from about 5 μM to about 10 μM, from about 10 μM to about 25 μM, from about 25 μM to about 50 μM, from about 50 μM to about 75 μM, from about 75 μM to about 100 μM.

An immunomodulatory polypeptide present in a TMMP of the present disclosure binds to its cognate co-immunomodulatory polypeptide with an affinity that it at least 10% less, at least 15% less, at least 20% less, at least 25% less, at least 30% less, at least 35% less, at least 40% less, at least 45% less, at least 50% less, at least 55% less, at least 60% less, at least 65% less, at least 70% less, at least 75% less, at least 80% less, at least 85% less, at least 90% less, at least 95% less, or more than 95% less, than the affinity of a corresponding wild-type immunomodulatory polypeptide for the cognate co-immunomodulatory polypeptide.

In some cases, a variant immunomodulatory polypeptide present in a TMMP of the present disclosure has a binding affinity for a cognate co-immunomodulatory polypeptide that is from 1 nM to 100 nM, or from 100 nM to 100 μM. For example, in some cases, a variant immunomodulatory polypeptide present in a TMMP of the present disclosure has a binding affinity for a cognate co-immunomodulatory polypeptide that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 μM, to about 1 μM to about 5 μM, from about 5 μM to about 10 μM, from about 10 μM to about 15 μM, from about 15 μM to about 20 μM, from about 20 μM to about 25 μM, from about 25 μM to about 50 μM, from about 50 μM to about 75 μM, from about 75 μM to about 100 μM. In some cases, a variant immunomodulatory polypeptide present in a T-cell modulatory multimeric polypeptide of the present disclosure has a binding affinity for a cognate co-immunomodulatory polypeptide that is from about 1 nM to about 5 nM, from about 5 nM to about 10 nM, from about 10 nM to about 50 nM, from about 50 nM to about 100 nM.

The combination of the reduced affinity of the immunomodulatory polypeptide for its cognate co-immunomodulatory polypeptide, and the affinity of the epitope for a TCR, provides for enhanced selectivity of a TMMP of the present disclosure. For example, a TMMP of the present disclosure binds selectively to a first T cell that displays both: i) a TCR specific for the epitope present in the TMMP; and ii) a co-immunomodulatory polypeptide that binds to the immunomodulatory polypeptide present in the T-cell modulatory multimeric polypeptide, compared to binding to a second T cell that displays: i) a TCR specific for an epitope other than the epitope present in the T-cell modulatory multimeric polypeptide; and ii) a co-immunomodulatory polypeptide that binds to the immunomodulatory polypeptide present in the TMMP. For example, a TMMP of the present disclosure binds to the first T cell with an affinity that is at least 10%, at least 15%, at least 20%, at least 25%, at least 30%, at least 40%, at least 50%, at least 60%, at least 70%, at least 80%, at least 90%, at least 2-fold, at least 2.5-fold, at least 5-fold, at least 10-fold, at least 15-fold, at least 20-fold, at least 25-fold, at least 50-fold, at least 100-fold, or more than 100-fold, higher than the affinity to which it binds the second T cell.

In some cases, a TMMP of the present disclosure, when administered to an individual in need thereof, induces both an epitope-specific T cell response and an epitope non-specific T cell response. In other words, in some cases, a TMMP of the present disclosure, when administered to an individual in need thereof, induces an epitope-specific T cell response by modulating the activity of a first T cell that displays both: i) a TCR specific for the epitope present in the T-cell modulatory multimeric polypeptide; ii) a co-immunomodulatory polypeptide that binds to the immunomodulatory polypeptide present in the TMMP; and induces an epitope non-specific T cell response by modulating the activity of a second T cell that displays: i) a TCR specific for an epitope other than the epitope present in the TMMP; and ii) a co-immunomodulatory polypeptide that binds to the immunomodulatory polypeptide present in the TMMP. The ratio of the epitope-specific T cell response to the epitope-non-specific T cell response is at least 2:1, at least 5:1, at least 10:1, at least 15:1, at least 20:1, at least 25:1, at least 50:1, or at least 100:1. The ratio of the epitope-specific T cell response to the epitope-non-specific T cell response is from about 2:1 to about 5:1, from about 5:1 to about 10:1, from about 10:1 to about 15:1, from about 15:1 to about 20:1, from about 20:1 to about 25:1, from about 25:1 to about 50:1, or from about 50:1 to about 100:1, or more than 100:1. "Modulating the activity" of a T cell can include one or more of: i) activating a cytotoxic (e.g., CD8$^+$) T cell; ii) inducing cytotoxic activity of a cytotoxic (e.g., CD8$^+$) T cell; iii) inducing production and release of a cytotoxin (e.g., a perforin; a granzyme; a granulysin) by a cytotoxic (e.g., CD8$^+$) T cell; iv) inhibiting activity of an autoreactive T cell; and the like.

The combination of the reduced affinity of the immunomodulatory polypeptide for its cognate co-immunomodulatory polypeptide, and the affinity of the epitope for a TCR, provides for enhanced selectivity of a TMMP of the present disclosure. Thus, for example, a TMMP of the present disclosure binds with higher avidity to a first T cell that displays both: i) a TCR specific for the epitope present in the TMMP; and ii) a co-immunomodulatory polypeptide that binds to the immunomodulatory polypeptide present in the TMMP, compared to the avidity to which it binds to a second T cell that displays: i) a TCR specific for an epitope other than the epitope present in the TMMP; and ii) a co-immunomodulatory polypeptide that binds to the immunomodulatory polypeptide present in the TMMP.

Determining Binding Affinity

Binding affinity between an immunomodulatory polypeptide and its cognate co-immunomodulatory polypeptide can be determined by bio-layer interferometry (BLI) using purified immunomodulatory polypeptide and purified cognate co-immunomodulatory polypeptide. Binding affinity between a synTac (TMMP) of the present disclosure and its cognate co-immunomodulatory polypeptide can also be determined by BLI using purified synTac and the cognate co-immunomodulatory polypeptide. BLI methods are well known to those skilled in the art. See, e.g., Lad et al. (2015) *J. Biomol. Screen.* 20(4):498-507; and Shah and Duncan (2014) *J. Vis. Exp.* 18:e51383. The specific and relative binding affinities described in this disclosure between an immunomodulatory polypeptide and its cognate co-immunomodulatory polypeptide, or between a synTac and its cognate co-immunomodulatory polypeptide, can be determined using the following procedures.

To determine binding affinity between a synTac of the present disclosure and its cognate co-immunomodulatory polypeptide, a BLI assay can be carried out using an Octet RED 96 (Pal FortéBio) instrument, or a similar instrument, as follows. To determine binding affinity of a T-cell modulatory multimeric polypeptide (e.g., a synTac of the present disclosure; or a control T-cell modulatory multimeric polypeptide (where a control TMMP comprises a wild-type immunomodulatory polypeptide)), the T-cell modulatory multimeric polypeptide is immobilized onto an insoluble support (a "biosensor"). The immobilized TMMP is the "target." Immobilization can be effected by immobilizing a capture antibody onto the insoluble support, where the capture antibody immobilizes the TMMP. For example, immobilization can be effected by immobilizing anti-Fc (e.g., anti-human IgG Fc) antibodies onto the insoluble support, where the immobilized anti-Fc antibodies bind to and immobilize the TMMP (where the TMMP comprises an IgFc polypeptide). A co-immunomodulatory polypeptide is applied, at several different concentrations, to the immobilized TMMP, and the instrument's response recorded. Assays are conducted in a liquid medium comprising 25 mM HEPES pH 6.8, 5% poly(ethylene glycol) 6000, 50 mM KCl, 0.1% bovine serum albumin, and 0.02% Tween 20 nonionic detergent. Binding of the co-immunomodulatory polypeptide to the immobilized TMMP is conducted at 30° C. As a positive control for binding affinity, an anti-MHC Class I monoclonal antibody can be used. For example, anti-HLA Class I monoclonal antibody W6/32 (American Type Culture Collection No. HB-95; Parham et al. (1979) *J. Immunol.* 123:342), which has a $K_D$ of 7 nM, can be used. A standard curve can be generated using serial dilutions of the anti-MHC Class I monoclonal antibody. The co-immunomodulatory polypeptide, or the anti-MHC Class I mAb, is the "analyte." BLI analyzes the interference pattern of white light reflected from two surfaces: i) from the immobilized polypeptide ("target"); and ii) an internal reference layer. A change in the number of molecules ("analyte"; e.g., co-immunomodulatory polypeptide; anti-HLA antibody) bound to the biosensor tip causes a shift in the interference pattern; this shift in interference pattern can be measured in real time. The two kinetic terms that describe the affinity of the target/analyte interaction are the association constant ($k_a$) and dissociation constant ($k_d$) The ratio of these two terms ($k_d/k_a$) gives rise to the affinity constant $K_D$.

As noted above, determining binding affinity between an immunomodulatory polypeptide (e.g., IL-2 or an IL-2 variant) and its cognate co-immunomodulatory polypeptide (e.g., IL-2R) also can be determined by BLI. The assay is similar to that described above for the synTac multimeric polypeptide. A BLI assay can be carried out using an Octet RED 96 (Pal FortéBio) instrument, or a similar instrument, as follows. A component immunomodulatory polypeptide of a synTac of the present disclosure (e.g., a variant IL-2 polypeptide of the present disclosure); and a control immunomodulatory polypeptide (where a control immunomodulatory polypeptide comprises a wild-type immunomodulatory polypeptide, e.g. wild-type IL-2)) are immobilized onto an insoluble support (a "biosensor"). The immunomodulatory polypeptide is the "target." Immobilization can be effected by immobilizing a capture antibody onto the insoluble support, where the capture antibody immobilizes the immunomodulatory polypeptide. For example, if the target is fused to an immuno-affinity tag (e.g. FLAG, human IgG Fc) immobilization can be effected by immobilizing with the appropriate antibody to the immuno-affinity tag (e.g. anti-human IgG Fc) onto the insoluble support, where the immobilized antibodies bind to and immobilize the immunomodulatory polypeptide (where the immunomodulatory polypeptide comprises an Ig Fc polypeptide). A co-immunomodulatory polypeptide (or polypeptides) is applied, at several different concentrations, to the immobilized immunomodulatory polypeptide, and the instrument's response recorded. Alternatively, a co-immunomodulatory polypeptide (or polypeptides) is immobilized to the biosensor (e.g., for the IL-2 receptor heterotrimer, as a monomeric subunit, heterodimeric subcomplex, or the complete heterotrimer) and the immunomodulatory polypeptide is applied, at several different concentrations, to the immobilized coimmunomodulatory polypeptide(s), and the instrument's response is recorded. Assays are conducted in a liquid medium comprising 25 mM HEPES pH 6.8, 5% poly(ethylene glycol) 6000, 50 mM KCl, 0.1% bovine serum albumin, and 0.02% Tween 20 nonionic detergent. Binding of the co-immunomodulatory polypeptide to the immobilized immunomodulatory polypeptide is conducted at 30° C. As a positive control for binding affinity, an anti-MHC Class I monoclonal antibody can be used. For example, anti-HLA Class I monoclonal antibody W6/32 (American Type Culture Collection No. HB-95; Parham et al. (1979) *J. Immunol.* 123:342), which has a $K_D$ of 7 nM, can be used. A standard curve can be generated using serial dilutions of the anti-MHC Class I monoclonal antibody. The co-immunomodulatory polypeptide, or the anti-MHC Class I mAb, is the "analyte." BLI analyzes the interference pattern of white light reflected from two surfaces: i) from the immobilized polypeptide ("target"); and ii) an internal reference layer. A change in the number of molecules ("analyte"; e.g., co-immunomodulatory polypeptide; anti-HLA antibody) bound to the biosensor tip causes a shift in the interference pattern; this shift in interference pattern can be measured in real time. The two kinetic terms that describe the affinity of the target/analyte interaction are the association constant ($k_a$) and dissociation constant ($k_d$). The ratio of these two terms ($k_d/k_a$) gives rise to the affinity constant $K_D$. Determining the binding affinity of both a wild-type immunomodulatory polypeptide (e.g., IL-2) for its receptor (e.g., IL-2R) and a variant immunomodulatory polypeptide (e.g., an IL-2 variant as disclosed herein) for its cognate co-immunomodulatory polypeptide (e.g., its receptor) (e.g., IL-2R) thus allows one to determine the relative binding affinity of the variant co-immunomodulatory polypeptide, as compared to the wild-type co-immunomodulatory polypeptide, for the cognate co-immunomodulatory polypeptide. That is, one can determine whether the binding affinity of a variant immunomodulatory polypeptide for its receptor (its cognate co-immunomodulatory polypeptide) is reduced as compared to the binding affinity of the wild-type immunomodulatory polypeptide for the same cognate co-immunomodulatory polypeptide, and, if so, what is the percentage reduction from the binding affinity of the wild-type co-immunomodulatory polypeptide.

The BLI assay is carried out in a multi-well plate. To run the assay, the plate layout is defined, the assay steps are defined, and biosensors are assigned in Octet Data Acquisition software. The biosensor assembly is hydrated. The hydrated biosensor assembly and the assay plate are equilibrated for 10 minutes on the Octet instrument. Once the data are acquired, the acquired data are loaded into the Octet Data Analysis software. The data are processed in the Processing window by specifying method for reference subtraction, y-axis alignment, inter-step correction, and Savitzky-Golay filtering. Data are analyzed in the Analysis window by specifying steps to analyze (Association and Dissociation), selecting curve fit model (1:1), fitting method (global), and window of interest (in seconds). The quality of fit is evaluated. $K_D$ values for each data trace (analyte concentration) can be averaged if within a 3-fold range. $K_D$ error values should be within one order of magnitude of the affinity constant values; $R^2$ values should be above 0.95. See, e.g., Abdiche et al. (2008) *J. Anal. Biochem.* 377:209.

Unless otherwise stated herein, the affinity of a TMMP of the present disclosure for a cognate co-immunomodulatory polypeptide, or the affinity of a control T-cell modulatory multimeric polypeptide (where a control TMMP comprises a wild-type immunomodulatory polypeptide) for a cognate co-immunomodulatory polypeptide, is determined using BLI, as described above.

In some cases, the ratio of: i) the binding affinity of a control T-cell modulatory multimeric polypeptide (where the control comprises a wild-type immunomodulatory polypeptide) to a cognate co-immunomodulatory polypeptide to ii) the binding affinity of a TMMP of the present disclosure comprising a variant of the wild-type immunomodulatory polypeptide to the cognate co-immunomodulatory polypeptide, when measured by BLI (as described above), is at least 1.5:1, at least 2:1, at least 5:1, at least 10:1, at least 15:1, at least 20:1, at least 25:1, at least 50:1, at least 100:1, at least 500:1, at least $10^2$:1, at least $5 \times 10^2$:1, at least $10^3$:1, at least $5 \times 10^3$:1, at least $10^4$:1, at least $10^5$:1, or at least $10^6$:1. In some cases, the ratio of: i) the binding affinity of a control TMMP (where the control comprises a wild-type immunomodulatory polypeptide) to a cognate co-immunomodulatory polypeptide to ii) the binding affinity of a TMMP of the present disclosure comprising a variant of the wild-type immunomodulatory polypeptide to the cognate co-immunomodulatory polypeptide, when measured by BLI, is in a range of from 1.5:1 to $10^6$:1, e.g., from 1.5:1 to 10:1, from 10:1 to 50:1, from 50:1 to $10^2$:1, from $10^2$:1 to $10^3$:1, from $10^3$:1 to $10^4$:1, from $10^4$:1 to $10^5$:1, or from $10^5$:1 to $10^6$:1.

As an example, where a control TMMP comprises a wild-type IL-2 polypeptide, and where a TMMP of the present disclosure comprises a variant IL-2 polypeptide (comprising from 1 to 10 amino acid substitutions relative to the amino acid sequence of the wild-type IL-2 polypeptide) as the immunomodulatory polypeptide, the ratio of: i) the binding affinity of the control TMMP to an IL-2 receptor (i.e., the cognate co-immunomodulatory polypeptide) to ii) the binding affinity of the TMMP of the present disclosure to the IL-2 receptor, when measured by BLI, is at least 1.5:1, at least 2:1, at least 5:1, at least 10:1, at least 15:1, at least 20:1, at least 25:1, at least 50:1, at least 100:1, at least 500:1, at least $10^2$:1, at least $5 \times 10^2$:1, at least $10^3$:1, at least $5 \times 10^3$:1, at least $10^4$:1, at least $10^5$:1, or at least $10^6$:1. In some cases, where a control TMMP comprises a wild-type IL-2 polypeptide, and where a TMMP of the present disclosure comprises a variant IL-2 polypeptide (comprising from 1 to 10 amino acid substitutions relative to the amino acid sequence of the wild-type IL-2 polypeptide) as the immunomodulatory polypeptide, the ratio of: i) the binding affinity of the control TMMP to an IL-2 receptor (i.e., the cognate co-immunomodulatory polypeptide) to ii) the binding affinity of the TMMP of the present disclosure to the IL-2 receptor, when measured by BLI, is in a range of from 1.5:1 to $10^6$:1, e.g., from 1.5:1 to 10:1, from 10:1 to 50:1, from 50:1 to $10^2$:1, from $10^2$:1 to $10^3$:1, from $10^3$:1 to $10^4$:1, from $10^4$:1 to $10^5$:1, or from $10^5$:1 to $10^6$:1.

As another example, where a control TMMP comprises a wild-type PD-L1 polypeptide, and where a TMMP of the present disclosure comprises a variant PD-L1 polypeptide (comprising from 1 to 10 amino acid substitutions relative to the amino acid sequence of the wild-type PD-L1 polypeptide) as the immunomodulatory polypeptide, the ratio of: i) the binding affinity of the control TMMP to a PD-1 polypeptide (i.e., the cognate co-immunomodulatory polypeptide) to ii) the binding affinity of the TMMP of the present disclosure to the PD-1 polypeptide, when measured by BLI, is at least 1.5:1, at least 2:1, at least 5:1, at least 10:1, at least 15:1, at least 20:1, at least 25:1, at least 50:1, at least 100:1, at least 500:1, at least $10^2$:1, at least $5 \times 10^2$:1, at least $10^3$:1, at least $5 \times 10^3$:1, at least $10^4$:1, at least $10^5$:1, or at least $10^6$:1.

As another example, where a control TMMP comprises a wild-type CD80 polypeptide, and where a TMMP of the present disclosure comprises a variant CD80 polypeptide (comprising from 1 to 10 amino acid substitutions relative to the amino acid sequence of the wild-type CD80 polypeptide) as the immunomodulatory polypeptide, the ratio of: i) the binding affinity of the control TMMP to a CTLA4 polypeptide (i.e., the cognate co-immunomodulatory polypeptide) to ii) the binding affinity of the TMMP of the present disclosure to the CTLA4 polypeptide, when measured by BLI, is at least 1.5:1, at least 2:1, at least 5:1, at least 10:1, at least 15:1, at least 20:1, at least 25:1, at least 50:1, at least 100:1, at least 500:1, at least $10^2$:1, at least $5 \times 10^2$:1, at least $10^3$:1, at least $5 \times 10^3$:1, at least $10^4$:1, at least $10^5$:1, or at least $10^6$:1.

As another example, where a control TMMP comprises a wild-type CD80 polypeptide, and where a TMMP of the present disclosure comprises a variant CD80 polypeptide (comprising from 1 to 10 amino acid substitutions relative to the amino acid sequence of the wild-type CD80 polypeptide) as the immunomodulatory polypeptide, the ratio of: i) the binding affinity of the control TMMP to a CD28 polypeptide (i.e., the cognate co-immunomodulatory polypeptide) to ii) the binding affinity of the TMMP of the present disclosure to the CD28 polypeptide, when measured by BLI, is at least 1.5:1, at least 2:1, at least 5:1, at least 10:1, at least 15:1, at least 20:1, at least 25:1, at least 50:1, at least 100:1, at least 500:1, at least $10^2$:1, at least $5 \times 10^2$:1, at least $10^3$:1, at least $5 \times 10^3$:1, at least $10^4$:1, at least $10^5$:1, or at least $10^6$:1.

As another example, where a control TMMP comprises a wild-type 4-1BBL polypeptide, and where a TMMP of the present disclosure comprises a variant 4-1BBL polypeptide (comprising from 1 to 10 amino acid substitutions relative to the amino acid sequence of the wild-type 4-1BBL polypeptide) as the immunomodulatory polypeptide, the ratio of: i) the binding affinity of the control TMMP to a 4-1BB polypeptide (i.e., the cognate co-immunomodulatory polypeptide) to ii) the binding affinity of the TMMP of the present disclosure to the 4-1BB polypeptide, when measured by BLI, is at least 1.5:1, at least 2:1, at least 5:1, at least 10:1, at least 15:1, at least 20:1, at least 25:1, at least 50:1, at least 100:1, at least 500:1, at least $10^2$:1, at least $5 \times 10^2$:1, at least $10^3$:1, at least $5 \times 10^3$:1, at least $10^4$:1, at least $10^5$:1, or at least $10^6$:1.

As another example, where a control TMMP comprises a wild-type CD86 polypeptide, and where a TMMP of the present disclosure comprises a variant CD86 polypeptide (comprising from 1 to 10 amino acid substitutions relative to the amino acid sequence of the wild-type CD86 polypeptide) as the immunomodulatory polypeptide, the ratio of: i) the binding affinity of the control TMMP to a CD28 polypeptide (i.e., the cognate co-immunomodulatory polypeptide) to ii) the binding affinity of the TMMP of the present disclosure to the CD28 polypeptide, when measured by BLI, is at least 1.5:1, at least 2:1, at least 5:1, at least 10:1, at least 15:1, at least 20:1, at least 25:1, at least 50:1, at least 100:1, at least 500:1, at least $10^2$:1, at least $5 \times 10^2$:1, at least $10^3$:1, at least $5 \times 10^3$:1, at least $10^4$:1, at least $10^5$:1, or at least $10^6$:1.

In some cases, when measured as described in the preceding paragraph, a T-cell modulatory multimeric polypeptide of the present disclosure exhibits selective binding to target T-cell, compared to binding of the T-cell modulatory multimeric polypeptide library member to a control T cell that comprises: i) the cognate co-immunomodulatory polypeptide that binds the parental wild-type immunomodulatory polypeptide: and ii) a T-cell receptor that binds to an epitope other than the epitope present in the T-cell modulatory multimeric polypeptide library member.

Dimerized Multimeric T-cell Modulatory Polypeptides

A TMMP of the present disclosure can be dimerized; i.e., the present disclosure provides a multimeric polypeptide comprising a dimer of a TMMP of the present disclosure. Thus, the present disclosure provides a TMMP comprising: A) a first heterodimer comprising: a) a first polypeptide comprising: i) a peptide epitope; and ii) a first major histocompatibility complex (MHC) polypeptide; and b) a second polypeptide i) a second MHC polypeptide, wherein the first heterodimer comprises one or more immunomodulatory polypeptides; and B) a second heterodimer comprising: a) a first polypeptide comprising: i) a peptide epitope; and ii) a first MHC polypeptide; and b) a second polypeptide comprising a second MHC polypeptide, wherein the second heterodimer comprises one or more immunomodulatory polypeptides, and wherein the first heterodimer and the second heterodimer are covalently linked to one another. In some cases, the two TMMPs are identical to one another in amino acid sequence. In some cases, the first heterodimer and the second heterodimer are covalently linked to one another via a C-terminal region of the second polypeptide of the first heterodimer and a C-terminal region of the second polypeptide of the second heterodimer. In some cases, first heterodimer and the second heterodimer are covalently linked to one another via the C-terminal amino acid of the second polypeptide of the first heterodimer and the C-terminal region of the second polypeptide of the second heterodimer; for example, in some cases, the C-terminal amino acid of the second polypeptide of the first heterodimer and the C-terminal region of the second polypeptide of the second heterodimer are linked to one another, either directly or via a linker. The linker can be a peptide linker. The peptide linker can have a length of from 1 amino acid to 200 amino acids (e.g., from 1 amino acid (aa) to 5 aa, from 5 aa to 10 aa, from 10 aa to 25 aa, from 25 aa to 50 aa, from 50 aa to 100 aa, from 100 aa to 150 aa, or from 150 aa to 200 aa). In some cases, the peptide epitope of the first heterodimer and the peptide epitope of the second heterodimer comprise the same amino acid sequence. In some cases, the first MHC polypeptide of the first and the second heterodimer is an MHC Class I β2-microglobulin, and wherein the second MHC polypeptide of the first and the second heterodimer is an MHC Class I heavy chain. In some cases, the immunomodulatory polypeptide of the first heterodimer and the immunomodulatory polypeptide of the second heterodimer comprise the same amino acid sequence. In some cases, the immunomodulatory polypeptide of the first heterodimer and the immunomodulatory polypeptide of the second heterodimer are variant immunomodulatory polypeptides that comprise from 1 to 10 amino acid substitutions compared to a corresponding parental wild-type immunomodulatory polypeptide, and wherein the from 1 to 10 amino acid substitutions result in reduced affinity binding of the variant immunomodulatory polypeptide to a cognate co-immunomodulatory polypeptide. In some cases, the immunomodulatory polypeptide of the first heterodimer and the immunomodulatory polypeptide of the second heterodimer are both selected from the group consisting of IL-2, 4-1BBL, PD-L1, CD80, CD86, B7-1, ICOS-L, OX-40L, FasL, JAG1 (CD339), TGFβ, and PD-L1. Examples, of suitable MHC polypeptides, immunomodulatory polypeptides, and peptide epitopes are described below.

MHC Polypeptides

As noted above, a TMMP of the present disclosure includes MHC polypeptides. For the purposes of the instant disclosure, the term "major histocompatibility complex (MHC) polypeptides" is meant to include MHC polypeptides of various species, including human MHC (also referred to as human leukocyte antigen (HLA)) polypeptides, rodent (e.g., mouse, rat, etc.) MHC polypeptides, and MHC polypeptides of other mammalian species (e.g., lagomorphs, non-human primates, canines, felines, ungulates (e.g., equines, bovines, ovines, caprines, etc.), and the like. The term "MHC polypeptide" is meant to include Class I MHC polypeptides (e.g., β-2 microglobulin and MHC class I heavy chain).

In some cases, the first MHC polypeptide is an MHC Class I β2M (β2M) polypeptide, and the second MHC polypeptide is an MHC Class I heavy chain (H chain) ("MHC-H")). In other instances, the first MHC polypeptide is an MHC Class I heavy chain polypeptide; and the second MHC polypeptide is a β2M polypeptide. In some cases, both the β2M and MHC-H chain are of human origin; i.e., the MHC-H chain is an HLA heavy chain, or a variant thereof. Unless expressly stated otherwise, a TMMP of the present disclosure does not include membrane anchoring domains (transmembrane regions) of an MHC Class I heavy chain, or a part of MHC Class I heavy chain sufficient to anchor the resulting TMMP to a cell (e.g., eukaryotic cell such as a mammalian cell) in which it is expressed. In some cases, the MHC Class 1 heavy chain present in a TMMP of the present disclosure does not include a signal peptide, a transmembrane domain, or an intracellular domain (cytoplasmic tail) associated with a native MHC Class I heavy chain. Thus, e.g., in some cases, the MHC Class I heavy chain present in a TMMP of the present disclosure includes only the α1, α2, and α3 domains of an MHC Class I heavy chain. In some cases, the MHC Class I heavy chain present in a TMMP of the present disclosure has a length of from about 270 amino acids (aa) to about 290 aa. In some cases, the MHC Class I heavy chain present in a TMMP of the present disclosure has a length of 270 aa, 271 aa, 272 aa, 273 aa, 274 aa, 275 aa, 276 aa, 277 aa, 278 aa, 279 aa, 280 aa, 281 aa, 282 aa, 283 aa, 284 aa, 285 aa, 286 aa, 287 aa, 288 aa, 289 aa, or 290 aa.

In some cases, an MHC polypeptide of a TMMP is a human MHC polypeptide, where human MHC polypeptides are also referred to as "human leukocyte antigen" ("HLA") polypeptides. In some cases, an MHC polypeptide of a TMMP is a Class I HLA polypeptide, e.g., a β2-microglobulin polypeptide, or a Class I HLA heavy chain polypeptide. Class I HLA heavy chain polypeptides include HLA-A heavy chain polypeptides, HLA-B heavy chain polypeptides, HLA-C heavy chain polypeptides, HLA-E heavy chain polypeptides, HLA-F heavy chain polypeptides, and HLA-G heavy chain polypeptides.

MHC Class I Heavy Chains

In some cases, an MHC Class I heavy chain polypeptide present in a TMMP of the present disclosure comprises an amino acid sequence having at least 75%, at least 80%, at least 85%, at least 90%, at least 95%, at least 98%, at least 99%, or 100%, amino acid sequence identity to all or part (e.g., 50, 75, 100, 150, 200, or 250 contiguous amino acids) of the amino acid sequence of any of the human HLA heavy chain polypeptides depicted in FIGS. 24-30. In some cases, the MHC Class I heavy chain has a length of 270 aa, 271 aa, 272 aa, 273 aa, 274 aa, 275 aa, 276 aa, 277 aa, 278 aa, 279 aa, 280 aa, 281 aa, 282 aa, 283 aa, 284 aa, 285 aa, 286 aa, 287 aa, 288 aa, 289 aa, or 290 aa. In some cases, an MHC Class I heavy chain polypeptide present in a TMMP of the present disclosure comprises 1-30, 1-5, 5-10, 10-15, 15-20, 20-25 or 25-30 amino acid insertions, deletions, and/or substitutions (in addition to those locations indicated as being variable in the heavy chain consensus sequences) of any one of the amino acid sequences depicted in FIGS. 24-30. In some cases, the MHC Class 1 heavy chain does not include transmembrane or cytoplasmic domains. As an example, a MHC Class I heavy chain polypeptide of a TMMP of the present disclosure can comprise an amino acid sequence having at least 75%, at least 80%, at least 85%, at least 90%, at least 95%, at least 98%, at least 99%, or 100%, amino acid sequence identity to amino acids 25-300 (lacking all, or substantially all, of the leader, transmembrane and cytoplasmic sequence) or amino acids 25-365 (lacking the leader) of a human HLA-A heavy chain polypeptides depicted in any one of FIGS. 24A, 24B, and 24C.

FIGS. 24A, 24B and 24C provide amino acid sequences of human leukocyte antigen (HLA) Class I heavy chain polypeptides. Signal sequences, amino acids 1-24, are bolded and underlined. FIG. 24A entry: 24A.1 is the HLA-A heavy chain (HLA-A*01:01:01:01 or A*0101) (NCBI accession NP_001229687.1) (SEQ ID NO:216); entry 24A.2 is from HLA-A*1101 (SEQ ID NO:294): entry 24A.3 is from HLA-A*2402 (SEQ ID NO:295), and entry 24A.4 is from HLA-A*3303 (SEQ ID NO:296). FIG. 24B provides the sequence HLA-B*07:02:01 (HLA-B*0702) (SEQ ID NO:217) NCBI GenBank Accession NP_005505.2 (see also GenBank Accession AUV50118.1.). FIG. 24C provides the sequence HLA-C*0701 (GenBank Accession NP_001229971.1) (HLA-C*07:01:01:01 or HLA-Cw*070101, HLA-Cw*07 sec GenBank Accession CAO78194.1) (SEQ ID NO:218).

FIG. 25 provides an alignment of eleven mature MHC class I heavy chain amino acid sequences without their leader sequences or transmembrane domains or intracellular domains. The aligned sequences are human HLA-A, HLA-B, and HLA-C, a mouse H2K protein sequence, three variants of HLA-A (var.1, var. 2C, and var.2CP), and 3 human HLA-A variants (HLA-A*1101 (SEQ ID NO:294); HLA-A*2402 (SEQ ID NO:295); and HLA-A*3303 (SEQ ID NO:296)). Indicated in the alignment are the locations (84 and 139 of the mature proteins) where cysteine residues may be introduced (e.g., by substitution) for the formation of a disulfide bond to stabilize the MHC H chain-β2M complex. Also shown in the alignment is position 236 (of the mature polypeptide), which may be substituted by a cysteine residue that can form an inter-chain disulfide bond with μ2M(e.g., at aa 12). An arrow appears above each of those locations and the residues are bolded. The seventh HLA-A sequence shown in the alignment (var. 2c), shows the sequence of variant 2 substituted with C residues at positions 84, 139 and 236. The boxes flanking residues 84, 139 and 236 show the groups of five amino acids on either sides of those six sets of five residues, denoted aac1 (for "amino acid cluster 1"), aac2 (for "amino acid cluster 2"), aac3 (for "amino acid cluster 3"), aac4 (for "amino acid cluster 4"), aac5 (for "amino acid cluster 5"), and aac6 (for "amino acid cluster 6"), that may be replaced by 1 to 5 amino acids selected independently from (i) any naturally occurring amino acid or (ii) any naturally occurring amino acid except proline or glycine.

With regard to FIG. 25, in some cases: i) aac1 (amino acid cluster 1) may be the amino acid sequence GTLRG (SEQ ID NO:219) or that sequence with one or two amino acids deleted or substituted with other naturally occurring amino acids (e.g., L replaced by I, V, A or F); ii) aac2 (amino acid cluster 2) may be the amino acid sequence YNQSE (SEQ ID NO:220) or that sequence with one or two amino acids deleted or substituted with other naturally occurring amino acids (e.g., N replaced by Q, Q replaced by N, and/or E replaced by D); iii) aac3 (amino acid cluster 3) may be the amino acid sequence TAADM (SEQ ID NO:221) or that sequence with one or two amino acids deleted or substituted with other naturally occurring amino acids (e.g.. T replaced by S, A replaced by G, D replaced by E and/or M replaced by L, V, or I); iv) aac4 (amino acid cluster 4) may be the amino acid sequence AQTTK (SEQ ID NO:222) or that sequence with one or two amino acids deleted or substituted with other naturally occurring amino acids (e.g., A replaced by G, Q replaced by N, or T replaced by S, and/or K replaced by R or Q); v) aac5 (amino acid cluster 5) may be the amino acid sequence VETRP (SEQ ID NO:223) or that sequence with one or two amino acids deleted or substituted with other naturally occurring amino acids (e.g., V replaced by I or L, E replaced by D, T replaced by S, and/or R replaced by K); and/or vi) aac6 (amino acid cluster 6) may be the amino acid sequence GDGTF (SEQ ID NO:224) or that sequence with one or two amino acids deleted or substituted with other naturally occurring amino acids (e.g., D replaced by E, T replaced by S, or F replaced by L, W, or Y).

FIG. 26-28 provide alignments of mature HLA class I heavy chain amino acid sequences (without leader sequences or transmembrane domains or intracellular domains). The aligned amino acid sequences in FIG. 26A are HLA-A class I heavy chains of the following alleles: A*0101, A*0201, A*0301, A*1101, A*2301. A*2402, A*2407, A*3303, and A*3401. The aligned amino acid sequences in FIG. 27A are HLA-B class I heavy chains of the following alleles: B*0702, B*0801, B*1502, B*3802, B*4001, B*4601, and B*5301. The aligned amino acid sequences in FIG. 28A are HLA-C class I heavy chains of the following alleles: C*0102, C*0303, C*0304, C*0401, C*0602, C*0701, C*0801, and C*1502. Indicated in the alignments are the locations (84 and 139 of the mature proteins) where cysteine residues may be introduced (e.g., by substitution) for the formation of a disulfide bond to stabilize the HLA H chain-β2M complex. Also shown in the alignment is position 236 (of the mature polypeptide), which may be substituted by a cysteine residue that can form an inter-chain disulfide bond with β2M (e.g., at aa 12). The boxes flanking residues 84, 139 and 236 show the groups of five amino acids on either sides of those six sets of five residues, denoted aac1 (for "amino acid cluster 1"), aac2 (for "amino acid cluster 2"), aac3 (for "amino acid cluster 3"), aac4 (for "amino acid cluster 4"), aac5 (for "amino acid cluster 5"), and aac6 (for "amino acid cluster 6"), that may be replaced by 1 to 5 amino acids selected independently from (i) any naturally occurring amino acid or (ii) any naturally occurring amino acid except proline or glycine.

FIGS. 26A, 27A, and 28A provide alignments of the amino acid sequences of mature HLA-A, -B, and -C class I heavy chains, respectively. The sequences are provided for the extracellular portion of the mature protein (without leader sequences or transmembrane domains or intracellular domains). As described in FIG. 25 the positions of aa residues 84, 139, and 236 and their flanking residues (aac1 to aac6) that may be replaced by 1 to 5 amino acids selected independently from (i) any naturally occurring amino acid or (ii) any naturally occurring amino acid except proline or glycine are also shown. FIGS. 26B, 27B, and 28B provide consensus amino acid sequences for the HLA-A, -B, and -C sequences, respectively, provided in FIGS. 26A, 27A, and 28A. The consensus sequences show the variable amino acid positions as "X" residues sequentially numbered and the locations of amino acids 84, 139, and 236 double underlined.

With regard to FIG. 26A, in some cases: i) aac1 (amino acid cluster 1) may be the amino acid sequence GTLRG (SEQ ID NO:219) or that sequence with one or two amino acids deleted or substituted with other naturally occurring amino acids (e.g., L replaced by I, V, A or F); ii) aac2 (amino acid cluster 2) may be the amino acid sequence YNQSE (SEQ ID NO:220) or that sequence with one or two amino acids deleted or substituted with other naturally occurring amino acids (e.g., N replaced by Q, Q replaced by N, and/or E replaced by D); iii) aac3 (amino acid cluster 3) may be the amino acid sequence TAADM (SEQ ID NO:221) or that sequence with one or two amino acids deleted or substituted with other naturally occurring amino acids (e.g., T replaced by S, A replaced by G, D replaced by E, and/or M replaced by L, V, or I); iv) aac4 (amino acid cluster 4) may be the amino acid sequence AQTTK (SEQ ID NO:222) or that sequence with one or two amino acids deleted or substituted with other naturally occurring amino acids (e.g., A replaced by G, Q replaced by N, or T replaced by S. and or K replaced by R or Q); v) aac5 (amino acid cluster 5) may be the amino acid sequence VETRP (SEQ ID NO:223) or that sequence with one or two amino acids deleted or substituted with other naturally occurring amino acids (e.g., V replaced by 1 or L, E replaced by D, T replaced by S, and/or R replaced by K); and/or vi) aac6 (amino acid cluster 6) may be the amino acid sequence GDGTF (SEQ ID NO:224) or that sequence with one or two amino acids deleted or substituted with other naturally occurring amino acids (e.g., D replaced by E, T replaced by S, or F replaced by L, W, or Y).

With regard to FIG. 27A, in some cases: i) aac1 (amino acid cluster 1) may be the amino acid sequence RNLRG (SEQ ID NO:297) or that sequence with one or two amino acids deleted or substituted with other naturally occurring amino acids (e.g., N replaced by T or I; and/or L replaced by A; and/or the second R replaced by L; and/or the G replaced by R); ii) aac2 (amino acid cluster 2) may be the amino acid sequence YNQSE (SEQ ID NO:220) or that sequence with one or two amino acids deleted or substituted with other naturally occurring amino acids (e.g., N replaced by Q, Q replaced by N, and/or E replaced by D); iii) aac3 (amino acid cluster 3) may be the amino acid sequence TAADT (SEQ ID NO:298) or that sequence with one or two amino acids deleted or substituted with other naturally occurring amino acids (e.g., the first T replaced by S; and/or A replaced by G; and/or D replaced by E; and/or the second T replaced by S); iv) aac4 (amino acid cluster 4) may be the amino acid sequence AQITQ (SEQ ID NO:299) or that sequence with one or two amino acids deleted or substituted with other naturally occurring amino acids (e.g., A replaced by G; and/or the first Q replaced by N; and/or I replaced by L or V; and/or the T replaced by S; and/or the second Q replaced by N); v) aac5 (amino acid cluster 5) may be the amino acid sequence VETRP (SEQ ID NO:223) or that sequence with one or two amino acids deleted or substituted with other naturally occurring amino acids (e.g., V replaced by I or L, E replaced by D, T replaced by S, and/or R replaced by K); and/or vi) aac6 (amino acid cluster 6) may be the amino acid sequence GDRTF (SEQ ID NO:300) or that sequence with one or two amino acids deleted or substituted with other naturally occurring amino acids (e.g., D replaced by E; and/or T replaced by S; and/or R replaced by K or H; and/or F replaced by L, W, or Y).

With regard to FIG. 28A, in some cases: i) aac1 (amino acid cluster 1) may be the amino acid sequence RNLRG (SEQ ID NO:297) or that sequence with one or two amino acids deleted or substituted with other naturally occurring amino acids (e.g., N replaced by K; and/or L replaced by A or I; and/or the second R replaced by H; and/or the G replaced by T or S); ii) aac2 (amino acid cluster 2) may be the amino acid sequence YNQSE (SEQ ID NO:220) or that sequence with one or two amino acids deleted or substituted with other naturally occurring amino acids (e.g., N replaced by Q, Q replaced by N, and/or E replaced by D); iii) aac3 (amino acid cluster 3) may be the amino acid sequence TAADT (SEQ ID NO:298) or that sequence with one or two amino acids deleted or substituted with other naturally occurring amino acids (e.g., the first T replaced by S; and/or A replaced by G; and/or D replaced by E; and/or the second T replaced by S); iv) aac4 (amino acid cluster 4) may be the amino acid sequence AQITQ (SEQ ID NO:299) or that sequence with one or two amino acids deleted or substituted with other naturally occurring amino acids (e.g., A replaced by G; and/or the first Q replaced by N; and/or I replaced by L; and/or the second Q replaced by N or K); v) aac5 (amino acid cluster 5) may be the amino acid sequence VETRP (SEQ ID NO:223) or that sequence with one or two amino acids deleted or substituted with other naturally occurring amino acids (e.g., V replaced by I or L, E replaced by D, T replaced by S, and/or R replaced by K or H); and/or vi) aac6 (amino acid cluster 6) may be the amino acid sequence GDGTF (SEQ ID NO:224) or that sequence with one or two amino acids deleted or substituted with other naturally occurring amino acids (e.g., D replaced by E; and/or T replaced by S; and/or F replaced by L, W, or Y).

HLA-A

In some cases, a TMMP of the present disclosure comprises an HLA-A heavy chain polypeptide. The HLA-A heavy chain peptide sequences, or portions thereof, that may be that may be incorporated into a TMMP of the present disclosure include, but are not limited to, the alleles: A*0101, A*0201, A*0301, A*1101, A*2301, A*2402, A*2407, A*3303, and A*3401, which are aligned without all, or substantially all, of the leader, transmembrane and cytoplasmic sequences in FIG. 26A. Any of those alleles may comprise a mutation at one or more of positions 84, 139 and/or 236 (as shown in FIG. 26A) selected from: a tyrosine to alanine at position 84 (Y84A); a tyrosine to cysteine at position 84 (Y84C); an alanine to cysteine at position 139 (A139C); and an alanine to cysteine substitution at position 236 (A236C). In addition, HLA-A sequence having at least 75% (e.g., at least 80%, at least 85%, at least 90%, at least 95%, at least 98%, at least 99%) or 100% amino acid sequence identity to all or part (e.g., 50, 75, 100, 150, 200, or 250 contiguous amino acids) of the sequence of those HLA-A alleles may also be employed (e.g., it may comprise 1-25, 1-5, 5-10, 10-15, 15-20, 20-25, or 25-30 amino acid insertions, deletions, and/or substitutions).

In some cases, a TMMP of the present disclosure comprises an HLA-A heavy chain polypeptide comprising the following HLA-A consensus amino acid sequence:

(SEQ ID NO: 301)
GSHSMRYFX1TSVSRPGRGEPRFIAVGYVDDTQFVRFDSDAASQX2MEPRA
PWIEQEGPEYWDX3X4TX5X6X7KAX8SQX9X10RX11X12LX13X14X15
X16X17YYNASEX18GSHTX19QX20MX21GCDVGX22DX23RFLRGYX24
QX25AYDGKDYIALX26EDLRSWTAADMA̱AQX27TX28TX29KWEX30X31
X32EAEQX33RX34YLX35GX36CVX37X38LRRYLENGKETLQRTDX39P
KTHMTHHX40X41SDHEATLRCWALX42FYPAEITLTWQRDGEDQTQDTEL
VETRPA̱GDGTFQKWAX43VVVPSGX44EQRYTCHVQHEGLPKPLTLRWE**X4
5**, wherein X1 is F, Y, S, or T; X2 is K or R; X3 is Q, G, E, or R; X4 is N or E; X5 is R or G; X6 is N or K; X7 is M or V; X8 is H or Q, X9 is T or I, X10 is D or H; X11 is A, V, or E; X12 is N or D; X13 is G or R; X14 is T or I; X15 is L or A; X16 is R or L; X17 is G or R; X18 is A or D; X19 is I, L, or V; X20 is I, R or M; X21 is F or Y; X22 is S or P; X23 is W or G; X24 is R, H, or Q; X25 is D or Y; X26 is N or K; X27 is T or I; X28 is K or Q; X29 is R or H; X30 is A or T; X31 is A or V; X32 is H or R; X33 is R, L, Q, or W; X34 is V or A; X35 is D or E; X36 is R or T; X37 is D or E; X38 is W or G; X39 is P or A; X40 is P or A; X41 is V or I; X42 is S or G; X43 is A or S; X44 is Q or E; and X45 is P or L.

As one example, an MHC Class I heavy chain polypeptide of a TMMP can comprise an amino acid sequence having at least 75%, at least 80%, at least 85%, at least 90%, at least 95%, at least 98%, at least 99%, or 100%, amino acid sequence identity to the following human HLA-A heavy chain amino acid sequence:

(SEQ ID NO: 53)
GSHSMRYFFTSVSRPGRGEPRFIAVGYVDDTQFVRFDSDAASQRMEPRAPW
IEQEGPEYWDGETRKVKAHSQTHRVDLGTLRGYYNQSEAGSHTVQRMYGCD
VGSDWRFLRGYHQYAYDGKDYIALKEDLRSWTAADMAAQTTKHKWEAAHVA
EQLRAYLEGTCVEWLRRYLENGKETLQRTDAPKTHMTHHAVSDHEATLRCW
ALSFYPAEITLTWQRDGEDQTQDTELVETRPAGDGTFQKWAAVVVPSGQEQ
RYTCHVQHEGLPKPLTLRWEP.

In some cases, an HLA-A heavy chain polypeptide suitable for inclusion in a TMMP of the present disclosure comprises the following amino acid sequence: GSHSMRYFFTSVSRPGRGEPRFIAVGYVDDTQFVRFDSDAASQRMEPRAPWIEQE GPEYWDGETRKVKAHSQTHRVDLGTLRGYYNQSEAGSHTVQRMYGCDVGSDW RFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPA EITLTWQRDGEDQTQDTELVETRPAGDGTFQKWAAVVVPSGQEQRYTCHVQHE GLPKPLTLRWEP (SEQ ID NO:53). This HLA-A heavy chain polypeptide is also referred to as "HLA-A*0201" or simply "HLA-A02." In some cases, the C-terminal Pro is not included in a TMMP of the present disclosure. For example, in some cases, an HLA-A02 polypeptide suitable for inclusion in a TMMP of the present disclosure comprises the following amino acid sequence:

(SEQ ID NO: 302)
GSHSMRYFFTSVSRPGRGEPRFIAVGYVDDTQFVRFDSDAASQRMEPRAPW
IEQEGPEYWDGETRKVKAHSQTHRVDLGTLRGYYNQSEAGSHTVQRMYGCD
VGSDWRFLRGYHQYAYDGKDYIALKEDLRSWTAADMAAQTTKHKWEAAHVA
EQLRAYLEGTCVEWLRRYLENGKETLQRTDAPKTHMTHHAVSDHEATLRCW
ALSFYPAEITLTWQRDGEDQTQDTELVETRPAGDGTFQKWAAVVVPSGQEQ
RYTCHVQHEGLPKPLTLRWE.

HLA-A (Y84A; A236C)

In some cases, the MHC Class I heavy chain polypeptide comprises Y84A and A236C substitutions. For example, in some cases, the MHC Class I heavy chain polypeptide comprises an amino acid sequence having at least 75%, at least 80%, at least 85%, at least 90%, at least 95%, at least 98%, at least 99%, or 100%, amino acid sequence identity to the following human HLA-A heavy chain (Y84A; A236C) amino acid sequence: GSHSMRYFFTSVSRPGRGEPRFIAVGYVDDTQFVRFDSDAASQRMEPRAPWIEQE GPEYWDGETRKVKAHSQTHRVDLGTLRGA̱YNQSEAGSHTVQRMYGCDVGSDW RFLRGYHQYAYDGKDYIALKEDLRSWTAADMAAQTTKHKWEAAHVAEQLRA YLEGTCVEWLRRYLENGKETLQRTDAPKTHMTHHAVSDHEATLRCWALSFYPA EITLTWQRDGEDQTQDTELVETRPC̱GDGTFQKWAAVVVPSGQEQRYTCHVQHE GLPKPLTLRWEP (SEQ ID NO:225), where amino acid 84 is Ala and amino acid 236 is Cys. In some cases, the Cys-236 forms an interchain disulfide bond with Cys-12 of a variant β2M polypeptide that comprises an R12C substitution.

In some cases, an HLA-A heavy chain polypeptide suitable for inclusion in a TMMP of the present disclosure is an HLA-A02 (Y84A; A236C) polypeptide comprising the following amino acid sequence:

(SEQ ID NO: 303)
GSHSMRYFFTSVSRPGRGEPRFIAVGYVDDTQFVRFDSDAASQRMEPRAPW
IEQEGPEYWDGETRKVKAHSQTHRVDLGTLRGA̱YNQSEAGSHTVQRMYGCD
VGSDWRFLRGYHQYAYDGKDYIALKEDLRSWTAADMAAQTTKHKWEAAHVA
EQLRAYLEGTCVEWLRRYLENGKETLQRTDAPKTHMTHHAVSDHEATLRCW
ALSFYPAEITLTWQRDGEDQTQDTELVETRPC̱GDGTFQKWAAVVVPSGQEQ
RYTCHVQHEGLPKPLTLRWEP.

In some cases, an HLA-A heavy chain polypeptide suitable for inclusion in a TMMP of the present disclosure is an HLA-A02 (Y84A; A236C) polypeptide comprising the following amino acid sequence:

(SEQ ID NO: 304)
GSHSMRYFFTSVSRPGRGEPRFIAVGYVDDTQFVRFDSDAASQRMEPRAPW

IEQEGPEYWDGETRKVKAHSQTHRVDLGTLRGAYNQSEAGSHTVQRMYGCD

VGSDWRFLRGYHQYAYDGKDYIALKEDLRSWTAADMAAQTTKHKWEAAHVA

EQLRAYLEGTCVEWLRRYLENGKETLQRTDAPKTHMTHHAVSDHEATLRCW

ALSFYPAEITLTWQRDGEDQTQDTELVETRPCGDGTFQKWAAVVVPSGQEQ

RYTCHVQHEGLPKPLTLRWE.

HLA-A (Y84C; A139C)

In some cases, the MHC Class I heavy chain polypeptide comprises Y84C and A139C substitutions. For example, in some cases, the MHC Class I heavy chain polypeptide comprises an amino acid sequence having at least 75%, at least 80%, at least 85%, at least 90%, at least 95%, at least 98%, at least 99%, or 100%, amino acid sequence identity to the following human HLA-A heavy chain (Y84C; A139C) amino acid sequence: GSHSMRYFFTSVSRPGRGEPRFIAVGYVDDTQFVRFDSDAASQRMEPRAPWIEQE GPEYWDGETRKVKAHSQTHRVDLGTLRGCYNQSEAGSHTVQRMYGCDVGSDW RFLRGYHQYAYDGKDYIALKEDLRSWTAADMCAQTTKHKWEAAHVAEQLRA YLEGTCVEWLRRYLENGKETLQRTDAPKTHMTHHAVSDHEATLRCWALSFYPA EITLTWQRDGEDQTQDTELVETRPAGDGTFQKWAAVVVPSGQEQRYTCHVQHE GLPKPLTLRWEP (SEQ ID NO:305), where amino acid 84 is Cys and amino acid 139 is Cys. In some cases, Cys-84 forms an intrachain disulfide bond with Cys-139.

HLA-A11 (HLA-A*1101)

As one non-limiting example, an MHC Class I heavy chain polypeptide of a TMMP can comprise an amino acid sequence having at least 75%, at least 80%, at least 85%, at least 90%, at least 95%, at least 98%, at least 99%, or 100%, amino acid sequence identity to the following human HLA-A11 heavy chain amino acid sequence: GSHSMRYFYTSVSRPGRGEPRFIAVGYVDDTQFVRFDSDAASQRMEPRAPWIEQ EGPEYWDQETRNVKAQSQTDRVDLGTLRGYYNQSEDGSHTIQIMYGCDVGPDG RFLRGYRQDAYDGKDYIALNEDLRSWTAADMAAQITKRKWEAAHAAEQQRAY LEGTCVEWLRRYLENGKETLQRTDPPKTHMTHHPISDHEATLRCWALGFYPAEI TLTWQRDGEDQTQDTELVETRPAGDGTFQKWAAVVVPSGEEQRYTCHVQHEGL PKPLTLRWE (SEQ ID NO:227). Such an MHC Class I heavy chain may be prominent in Asian populations, including populations of individuals of Asian descent.

HLA-A11 (Y84A; A236C)

As one non-limiting example, in some cases, the MHC Class I heavy chain polypeptide is an HLA-A11 allele that comprises Y84A and A236C substitutions. For example, in some cases, the MHC Class I heavy chain polypeptide comprises an amino acid sequence having at least 75%, at least 80%, at least 85%, at least 90%, at least 95%, at least 98%, at least 99%, or 100%, amino acid sequence identity to the following human HLA-A A11 heavy chain (Y84A; A236C) amino acid sequence: GSHSM-RYFYTSVSRPGRGEPRFIAVGYVDDTQFVRFDSDAASQRMEPRAPWIEQ EGPEYWDQETRNVKAQSQTDRVDLGTLRGAYNQSEDGSHTIQIMYGCD-VGPDG RFLRGYRQDAYDGKDYIALNEDLRSWTAA-DMAAQITKRKWEAAHAAEQQRAY LEGTCVEWLR-RYLENGKETLQRTDPPKTHMTHHPISDHEATLRC-WALGFYPAEI TLTWQRDGEDQTQDTELVETRP CGDGTFQKWAAVVVPSGEEQRYTCHVQHEGL PKPLTLRWE (SEQ ID NO:228), where amino acid 84 is Ala and amino acid 236 is Cys. In some cases, the Cys-236 forms an interchain disulfide bond with Cys-12 of a variant β2M polypeptide that comprises an R12C substitution.

HLA-A24 (HLA-A*2402)

As one non-limiting example, an MHC Class I heavy chain polypeptide of a TMMP of the present disclosure can comprise an amino acid sequence having at least 75%, at least 80%, at least 85%, at least 90%, at least 95%, at least 98%, at least 99%, or 100%, amino acid sequence identity to the following human HLA-A24 heavy chain amino acid sequence: GSHSMRYFSTSVSRPGRGEPRFIA-VGYVDDTQFVRFDSDAASQRMEPRAPWIEQE GPEYWDEETGKVKAHSQTDRENLRIALRYYNQSEA-GSHTLQMMFGCDVGSDGR FLRGYHQYAYDG-KDYIALKEDLRSWTAADMAAQITKRKWEAAH-VAEQQRAYL EGTCVDGLRRYLENGKETLQRTDPP-KTHMTHHPISDHEATLRCWALGFYPAEITL TWQRD-GEDQTQDTELVETRPAGDGTFQKWAAVVVPSGE-EQRYTCHVQHEGLP KPLTLRWEPSSQPTVPIVGI-IAGLVLLGAVITGAVVAAVMWRRNSSDRKGGSYSQ AASSDSAQGSDVSLTACKV (SEQ ID NO:306). Such an MHC Class I heavy chain may be prominent in Asian populations, including populations of individuals of Asian descent. In some cases, amino acid 84 is an Ala. In some cases, amino acid 84 is a Cys. In some cases, amino acid 236 is a Cys. In some cases, amino acid 84 is an Ala and amino acid 236 is a Cys. In some cases, amino acid 84 is an Cys and amino acid 236 is a Cys.

HLA-A33 (HLA-A*3303)

As one non-limiting example, an MHC Class I heavy chain polypeptide of a TMMP of the present disclosure can comprise an amino acid sequence having at least 75%, at least 80%, at least 85%, at least 90%, at least 95%, at least 98%, at least 99%, or 100%, amino acid sequence identity to the following human HLA-A33 heavy chain amino acid sequence: GSHSMRYFTTSVSRPGRGEPRFIAVGYVD-DTQFVRFDSDAASQRMEPRAPWIEQE GPEYWDRN-TRNVKAHSQIDRVDLGTLRGYYNQSEAGSHTIQM-MYGCDVGSDG RFLRGYQQDAYDGKDYIALNEDLR-SWTAADMAAQITQRKWEAARVAEQLRAY LEGTCVEWLRRYLENGKETLQRTDPPKTHMTHHA-VSDHEATLRCWALSFYPAET TLTWQRDGEDQ-TQDTELVETRPAGDGTFQKWASVVVPSGQEQRYT-CHVQHEGL PKPLTLRWEPSSQPTIPIVGIIAGLVLFGA-VFAGAVVAAVRWRRKSSDRKGGSYS QAASSD-SAQGSDMSLTACKV (SEQ ID NO:307). Such an MHC Class I heavy chain may be prominent in Asian populations, including populations of individuals of Asian descent. In some cases, amino acid 84 is an Ala. In some cases, amino acid 84 is a Cys. In some cases, amino acid 236 is a Cys. In some cases, amino acid 84 is an Ala and amino acid 236 is a Cys. In some cases, amino acid 84 is an Cys and amino acid 236 is a Cys.

HLA-B

In some cases, a TMMP of the present disclosure comprises an HLA-B heavy chain polypeptide. The HLA-B heavy chain peptide sequences, or portions thereof, that may be that may be incorporated into a TMMP of the present disclosure include, but are not limited to, the alleles: B*0702, B*0801, B*1502, B*3802, B*4001, B*4601, and B*5301, which are aligned without all, or substantially all, of the leader, transmembrane and cytoplasmic sequences in FIG. 27A. Any of those alleles may comprise a mutation at one or more of positions 84, 139 and/or 236 (as shown in FIG. 27A) selected from: a tyrosine to alanine at position 84 (Y84A); a tyrosine to cysteine at position 84 (Y84C); an alanine to cysteine at position 139 (A139C); and an alanine to cysteine substitution at position 236 (A236C). In addition, a HLA-B polypeptide comprising an amino acid sequence having at least 75% (e.g., at least 80%, at least 85%, at least 90%, at least 95%, at least 98%, at least 99%) or 100% amino acid sequence identity to all or part (e.g., 50, 75, 100, 150, 200, or 250 contiguous amino acids) of the sequence of those HLA-B alleles may also be employed (e.g., it may comprise 1-25, 1-5, 5-10, 10-15, 15-20, 20-25, or 25-30 amino acid insertions, deletions, and/or substitutions).

In some cases, a TMMP of the present disclosure comprises an HLA-B heavy chain polypeptide comprising the following HLA-B consensus amino acid sequence:

(SEQ ID NO: 308)
GSHSMRYFX1TX2X3SRPGRGEPRFIX4VGYVDDTX5FVRFDSDAX6SPRX

7X8PRAPWIEQEGPEYWDRX9TQX10X11KTX12X13TQX14YX15X16NL

X17X18X19X20YYNQSEAGSHX21X22QX23MYGCDLGPDGRLLRGHDQS

AYDGKDYIALNEDLX24SWTAADTAAQIX25QRKX26EAARX27AEQX28R

X29YLEGX30CVEWLRRYLENGKX31X32LX33RADPPKTHVTHHPX34SD

HEATLRCWALGFYPAEITLTWQRDGEDQTQDTELVETRPAGDRTFQKWAAV

VVPSGEEQRYTCHVQHEGLPKPLTLRWEP, wherein X1 is H, Y, or D; X2 is A or S; X3 is M or V; X4 is A, S, or T; X5 is Q or L; X6 is A or T; X7 is E, M K, or T; X8 is A or T; X9 is E or N; X10 is I or K; X11 is Y, F, S, or C; X12 is N or Q; X13 is A or T; X14 is D or Y; X15 is E or V; X16 is S or N; X17 is T, N, or I; X18 is A or L; X19 is L, or R; X20 is R or G; X21 is T or I; X22 is L or I; X23 is R or S; X24 is R or S; X25 is S or T; X26 is L or W; X27 is E OR V; X28 is R, D, L or W; X29 is A or T; X30 is L, E or T; X31 is E or D; X32 is K or T; X33 is E or Q; and X34 is I or V.

As an example, an MHC Class I heavy chain polypeptide of a TMMP of the present disclosure can comprise an amino acid sequence having at least 75%, at least 80%, at least 85%, at least 90%, at least 95%, at least 98%, at least 99%, or 100%, amino acid sequence identity to the following human HLA-B heavy chain amino acid sequence:

(SEQ ID NO: 229)
GSHSMRYFYTSVSRPGRGEPRFISVGYVDDTQFVRFDSDAASPREEPRAPW

IEQEGPEYWDRNTQIYKAQAQTDRESLRNLRGYYNQSEAGSHTLQSMYGCD

VGPDGRLLRGHDQYAYDGKDYIALNEDLRSWTAADTAAQITQRKWEAAREA

EQRRAYLEGECVEWLRRYLENGKDKLERADPPKTHVTHHPISDHEATLRCW

ALGFYPAEITLTWQRDGEDQTQDTELVETRPAGDRTFQKWAAVVVPSGEEQ

RYTCHVQHEGLPKPLTLRWEP.

HLA-B (Y84A; A236C)

As one non-limiting example, in some cases, the MHC Class I heavy chain polypeptide is an HLA-B polypeptide that comprises Y84A and A236C substitutions. For example, in some cases, the MHC Class I heavy chain polypeptide comprises an amino acid sequence having at least 75%, at least 80%, at least 85%, at least 90%, at least 95%, at least 98%, at least 99%, or 100%, amino acid sequence identity to the following human HLA-B heavy chain (Y84A; A236C) amino acid sequence: GSHSM-RYFYTSVSRPGRGEPRFISVGYVDDTQFVRFDS-DAASPREEPRAPWIEQE GPEYWDRNTQIYKAQAQT-DRESLRNLRGAYNQSEAGSHTLQSMYGCDVGPDGR LLRGHDQYAYDGKDYIALNEDLRSWTAAD-TAAQITQRKWEAAREAEQRRAYLE GECVEWLRRY-LENGKDKLERADPPKTHVTHHPISDHEATLRCWAL-GFYPAEITL TWQRDGEDQTQDTELVETRP CGDRTFQKWAAVVVPSGEEQRYTCHVQHEGLPK PLTLRWEP (SEQ ID NO:230), where amino acid 84 is Ala and amino acid 236 is Cys. In some cases, the Cys-236 forms an interchain disulfide bond with Cys-12 of a variant β2M polypeptide that comprises an R12C substitution.

HLA-B (Y84C; A139C)

In some cases, the MHC Class I heavy chain polypeptide comprises Y84C and A139C substitutions. For example, in some cases, the MHC Class I heavy chain polypeptide comprises an amino acid sequence having at least 75%, at least 80%, at least 85%, at least 90%, at least 95%, at least 98%, at least 99%, or 100%, amino acid sequence identity to the following human HLA-B heavy chain (Y84C; A139C) amino acid sequence: GSHSM-RYFYTSVSRPGRGEPRFTSVGYVDDTQFVRFDS-DAASPREEPRAPWIEQE GPEYWDRNTQIYKAQAQT-DRESLRNLRGCYNQSEAGSHTLQSMYGCDVGPDGR LLRGHDQYAYDGKDYIALNEDLRSWTAADT CAQITQRKWEAAREAEQRRAYLE GECVEWLRRY-LENGKDKLERADPPKTHVTHHPISDHEATLRCWAL-GFYPAEITL TWQRDGEDQTQDTELVETR-PAGDRTFQKWAAVVVPSGEEQRYTCHVQHEGLPK PLTLRWEP (SEQ ID NO:231), where amino acid 84 is Cys and amino acid 139 is Cys. In some cases, Cys-84 forms an interchain disulfide bond with Cys-139.

HLA-B*0702

As an example, in some cases, a MHC Class I heavy chain polypeptide present in a TMMP of the present disclosure comprises an amino acid sequence of HLA-B*0702 (SEQ ID NO:309) in FIG. 27A, or a sequence having at least 75% (e.g., at least 80%, at least 85%, at least 90%, at least 95%, at least 98%, at least 99%) or 100%, amino acid sequence identity to all or part (e.g., 50, 75, 100, 150, 200, or 250 contiguous amino acids) of that sequence (e.g., it may comprise 1-25, 1-5, 5-10, 10-15, 15-20, 20-25, or 25-30 amino acid insertions, deletions, and/or substitutions). In some cases, where the HLA-B heavy chain polypeptide of TMMP of the present disclosure has less than 100% identity to the sequence labeled HLA-B in FIG. 25, or labeled "B*0702 in FIG. 27A, it may comprise a mutation at one or more of positions 84, 139 and/or 236 selected from: a tyrosine to alanine substitution at position 84 (Y84A); a tyrosine to cysteine substitution at position 84 (Y84C); an alanine to cysteine at position 139 (A139C); and an alanine to cysteine substitution at position 236 (A236C). In some cases, the HLA-B heavy chain polypeptide of TMMP of the present disclosure comprises Y84A and A236C substitutions. In some cases, the HLA-B*0702 heavy chain polypeptide of TMMP of the present disclosure comprises Y84C and A139C substitutions. In some cases, the HLA-B heavy chain polypeptide of TMMP of the present disclosure comprises Y84C, A139C, and A236C substitutions.

HLA-C

In some cases, a TMMP of the present disclosure comprises an HLA-C heavy chain polypeptide. The HLA-C heavy chain polypeptide, or portions thereof, that may be that may be incorporated into a TMMP of the present disclosure include, but are not limited to, the alleles: C*0102, C*0303, C*0304, C*0401, C*0602, C*0701, C*0801, and C*1502, which are aligned without all, or substantially all, of the leader, transmembrane and cytoplasmic sequences in FIG. 28A. Any of those alleles may comprise a mutation at one or more of positions 84, 139 and/or 236 (as shown in FIG. 28A) selected from: a tyrosine to alanine substitution at position 84 (Y84A); a tyrosine to cysteine substitution at position 84 (Y84C); an alanine to cysteine substitution at position 139 (A139C); and an alanine to cysteine substitution at position 236 (A236C). In addition, an 1-ILA-C polypeptide comprising an amino acid sequence having at least 75% (e.g., at least 80%, at least 85%, at least 90%, at least 95%, at least 98%, at least 99%) or 100% amino acid sequence identity to all or part (e.g., 50, 75, 100, 150, 200, or 250 contiguous amino acids) of the sequence of those HLA-C alleles may also be employed (e.g., it may comprise 1-25, 1-5, 5-10, 10-15, 15-20, 20-25, or 25-30 amino acid insertions, deletions, and/or substitutions).

In some cases, a TMMP of the present disclosure comprises an HLA-C heavy chain polypeptide comprising the following HLA-C consensus amino acid sequence:

X1SHSMX2YFX3TAVSX4PGRGEPX5FIX6VGYVD-DTQFVX7FDSDAASPRGEPR X8PWVEQEGPEYW-DRETQX9YKRQAQX10DRVX11LRX12LRGYYNQSE X13X14SHX15X16QX17MX18GCDX19GPDGRLLRG X20X21QX22AYDGKDYIALNEDLR SWTAADT AAQITQRKX23EAARX24AEQX25RAYLEGX26CV-EWLRRYLX27NGK X28TLQRAEX29PKTHVTHHP X30SDHEATLRCWALGFYPAEITLTWQX31DGED QTQDTELVETRPAGDGTFQKWAAVX32VPSGX33EQ-RYTCHX34QHEGLX35EPL TLX36WX37P (SEQ ID NO:310), wherein X1 is C or G; X2 is R or K; X3 is F, Y, S, or D; X4 is R or W; X5 is H or R; X6 is A or S; X7 is Q or R; X8 is A or E: X9 is N or K; X10 is T or A; X11 is S or N; X12 is N or K; X13 is A or D; X14 is G or R; X15 is T or I; X16 is L or I; X17 is W or R; X18 is C, Y, F, or S; X19 is L, or V; X20 is Y or H: X21 is D or N; X22 is Y, F, S, or L; X23 is L or W; X24 is E, A, Or T; X25 is R, L, or W; X26 is L or T; X27 is E OR K; X28 is E or K; X29 is H or P; X30 is R or V; X31 is W or R; X32 is V or M; X33 is E or Q; X34 is M or V; X35 is P or Q; X36 is R or S; and X37 is P or G.

As an example, an MHC Class I heavy chain polypeptide of a TMMP of the present disclosure can comprise an amino acid sequence having at least 75%, at least 80%, at least 85%, at least 90%, at least 95%, at least 98%, at least 99%, or 100%, amino acid sequence identity to the following human HLA-C heavy chain amino acid sequence:

```
                                        (SEQ ID NO: 232)
CSHSMRYFDTAVSRPGRGEPRFISVGYVDDTQFVRFDSDAASPRGEPRAPW

VEQEGPEYWDRETQNYKRQAQADRVSLRNLRGYYNQSEDGSHTLQRMYGCD

LGPDGRLLRGYDQSAYDGKDYIALNEDLRSWTAADTAAQITQRKLEAARAA

EQLRAYLEGTCVEWLRRYLENGKETLQRAEPPKTHVTHHPLSDHEATLRCW

ALGFYPAEITLTWQRDGEDQTQDTELVETRPAGDGTFQKWAAVVVPSGQEQ

RYTCHMQHEGLQEPLTLSWEP.
```

HLA-C (Y84A; A236C)

As one non-limiting example, in some cases, the MHC Class I heavy chain polypeptide is an HLA-C polypeptide that comprises Y84A and A236C substitutions. For example, in some cases, the MHC Class I heavy chain polypeptide comprises an amino acid sequence having at least 75%, at least 80%, at least 85%, at least 90%, at least 95%, at least 98%, at least 99%, or 100%, amino acid sequence identity to the following human HLA-C heavy chain (Y84A; A236C) amino acid sequence: CSHSMRYFD-TAVSRPGRGEPRFISVGYVDDTQFVRFDSDAASPR-GEPRAPWVEQ EGPEYWDRETQNYKRQAQADR-VSLRNLRGAYNQSEDGSHTLQRMYGCDLGPD GRLLRGYDQSAYDGKDYIALNEDLRSWTAAD-TAAQITQRKLEAARAAEQLRAY LEGTCVEWLRRY-LENGKETLQRAEPPKTHVTHHPLSDHEATLRCWAL-GFYPAEI TLTWQRDGEDQTQDTELVETRPCGD-GTFQKWAAVVVPSGQEQRYTCHMQHEG LQE-PLTLSWEP (SEQ ID NO:233), where amino acid 84 is Ala and amino acid 236 is Cys. In some cases, the Cys-236 forms an interchain disulfide bond with Cys-12 of a variant β2M polypeptide that comprises an R12C substitution.

HLA-C (Y84C; A139C)

In some cases, the MHC Class I heavy chain polypeptide comprises Y84C and A139C substitutions. For example, in some cases, the MHC Class I heavy chain polypeptide comprises an amino acid sequence having at least 75%, at least 80%, at least 85%, at least 90%, at least 95%, at least 98%, at least 99%, or 100%, amino acid sequence identity to the following human HLA-C heavy chain (Y84C; A139C) amino acid sequence: CSHSMRYFD-TAVSRPGRGEPRFISVGYVDDTQFVRFDSDAASP-RGEPRAPWVEQ EGPEYWDRETQNYKRQAQADR-VSLRNLRGCYNQSEDGSHTLQRMYGCDLGPD GRLLRGYDQSAYDGKDYIALNEDLRSWTAADT CAQITQRKLEAARAAEQLRAY LEGTCVEWLRRY-LENGKETLQRAEPPKTHVTHHPLSDHEATLRCWAL-GFYPAEI TLTWQRDGEDQTQDTELVETRPAGDGT-FQKWAAVVVPSGQEQRYTCHMQHEG LQE-PLTLSWEP (SEQ ID NO:234), where amino acid 84 is Cys and amino acid 139 is Cys. In some cases, Cys-84 forms an intrachain disulfide bond with Cys-139.

HLA-C*0701

In some cases, a MHC Class I heavy chain polypeptide of a TMMP of the present disclosure comprises an amino acid sequence of HLA-C*0701 of FIG. 28A (labeled HLA-C in FIG. 25), or an amino acid sequence having at least 75% (e.g., at least 80%, at least 85%, at least 90%, at least 95%, at least 98%, at least 99%) or 100% amino acid sequence identity to all or part (e.g., 50, 75, 100, 150, 200, or 250 contiguous amino acids) of that sequence (e.g., it may comprise 1-25, 1-5, 5-10, 10-15, 15-20, 20-25, or 25-30 amino acid insertions, deletions, and/or substitutions). In some cases, where the HLA-C heavy chain polypeptide of a TMMP of the present disclosure has less than 100% identity to the sequence labeled HLA-C*0701 in FIG. 28A, it may comprise a mutation at one or more of positions 84, 139 and/or 236 selected from: a tyrosine to alanine substitution at position 84 (Y84A); a tyrosine to cysteine substitution at position 84 (Y84C); an alanine to cysteine at position 139 (A139C); and an alanine to cysteine substitution at position 236 (A236C). In some cases, the HLA-C heavy chain polypeptide of a TMMP of the present disclosure comprises Y84A and A236C substitutions. In some cases, the HLA-C*0701 heavy chain polypeptide of a T-Cell-MMP or its epitope conjugate comprises Y84C and A139C substitutions. In some cases, the HLA-C heavy chain polypeptide of a TMMP of the present disclosure comprises Y84C, A139C, and A236C substitutions.

Non-Classical HLA-E, -F, and -G MHC Class I Heavy Chains

In some cases, a TMMP of the present disclosure comprises a non-classical MHC Class I heavy chain polypeptide. Among the non-classical HLA heavy chain polypeptides, or portions thereof, that may be that may be incorporated into a TMMP of the present disclosure include, but are not limited to, those of HLA-E, -F, and -G alleles Amino acid sequences for HLA-E, -F, and -G heavy chain polypeptides, (and the HLA-A, B and C alleles) may be found on the world wide web hla.alleles.org/nomenclature/index.html, the European Bioinformatics Institute (www(dot)cbi(dot)ac(dot)uk), which is part of the European Molecular Biology Laboratory(EMBL), and at the National Center for Biotechnology Information (www(dot)ncbi(dot)nlm(dot)nih(dot)gov).

Non-limiting examples of suitable HLA-E alleles include, but are not limited to, HLA-E*0101 (HLA-E*01:01:01:01), HLA-E*01:03(HLA-E*01:03:01:01), HLA-E*01:04, HLA-E*01:05, HLA-E*01:06, HLA-E*01:07, HLA-E*01:09, and HLA-E*01:10. Non-limiting examples of suitable HLA-F alleles include, but are not limited to, HLA-F*0101 (HLA-F*01:01:01:01), HLA-F*01:02, HLA-F*01:03(HLA-F*01:03:01:01), HLA-F*01:04, HLA-F*01:05, and HLA-F*01:06. Non-limiting examples of suitable HLA-G alleles include, but are not limited to, HLA-G*0101 (HLA-G*01:01:01:01), HLA-G*01:02, HLA-G*01:03(HLA-G*01:03:01:01), HLA-G*01:04 (HLA-G*01:04:01:01), HLA-G*01:06, HLA-G*01:07, HLA-G*01:08, HLA-G*01:09: HLA-G*01:10, HLA-G*01:10, HLA-G*01:11, HLA-G*01:12, HLA-G*01:14, HLA-G*01:15, HLA-G*01:16, HLA-G*01:17, HLA-G*01:18: HLA-G*01:19, HLA-G*01:20, and HLA-G*01:22. Consensus sequences for those HLA E, -F and -G alleles without all, or substantially all, of the leader, transmembrane and cytoplasmic sequences are provided in FIG. 29, and aligned with consensus sequences of the above-mentioned HLA-A, -B and -C alleles in FIG. 30.

FIG. 29 provides a consensus sequence for each of HLA-E, -F, and -G with the variable aa positions indicated as "X" residues sequentially numbered and the locations of aas 84, 139 and 236 double underlined.

FIG. 30 provides an alignment of the consensus amino acid sequences for HLA-A (SEQ ID NO:301), -B (SEQ ID NO:308), -C (SEQ ID NO:310), -E (SEQ ID NO:397), -F (SEQ ID NO:398), and -G (SEQ ID NO:399), which are given in FIGS. 25-29. Variable residues in each sequence are listed as "X" with the sequential numbering removed. As indicated in FTG. 25, the locations of aas 84, 139 and 236 are indicated with their flanking five-amino acid clusters that may be replaced by 1 to 5 amino acids selected independently from (i) any naturally occurring amino acid or (ii) any naturally occurring amino acid except proline or glycine are also shown.

Any of the above-mentioned HLA-E, -F. and/or -G alleles may comprise a substitution at one or more of positions 84, 139 and/or 236 as shown in FIG. 30 for the consensus sequences. In some cases, the substitutions may be selected from a: position 84 tyrosine to alanine (Y84A) or cysteine (Y84C), or, in the case of HLA-F, an R84A or R84C substitution; a position 139 alanine to cysteine (A139C), or, in the case of HLA-F, a V139C: and an alanine to cysteine substitution at position 236 (A236C). In addition, an HLA-E, -F and/or -G sequence having at least 75% (e.g., at least 80%, at least 85%, at least 90%, at least 95%, at least 98%, at least 99%) or 100% amino acid sequence identity to all or part (e.g., 50, 75, 100, 150, 200, or 250 contiguous amino acids) of any of the consensus sequences of set forth in FIG. 30 may also be employed (e.g., the sequences may comprise 1-25, 1-5, 5-10, 10-15, 15-20, 20-25, or 25-30 amino acid insertions, deletions, and/or substitutions in addition to changes at variable residues listed therein).

Mouse H2K

In some cases, a MHC Class I heavy chain polypeptide present in a TMMP of the present disclosure comprises an amino acid sequence of MOUSE 1-12K (SEQ ID NO:311) (MOUSE H2K in FIG. 25), or a sequence having at least 75%, at least 80%, at least 85%, at least 90%, at least 95%, at least 98%, at least 99%, or 100% amino acid sequence identity to all or part (e.g., 50, 75, 100, 150, 200, or 250 contiguous amino acids) of that sequence (e.g., it may comprise 1-25, 1-5, 5-10, 10-15, 15-20, 20-25, or 25-30 amino acid insertions, deletions, and/or substitutions). In some cases, where the MOUSE H2K heavy chain polypeptide of a TMMP of the present disclosure has less than 100% identity to the sequence labeled MOUSE H2K in FIG. 25, it may comprise a mutation at one or more of positions 84, 139 and/or 236 selected from: a tyrosine to alanine at position 84 (Y84A); a tyrosine to cysteine at position 84 (Y84C); an alanine to cysteine at position 139 (A139C); and an alanine to cysteine substitution at position 236 (A236C). In some cases, the MOUSE H2K heavy chain polypeptide of a TMMP of the present disclosure comprises Y84A and A236C substitutions. In some cases, the MOUSE H2K heavy chain polypeptide of a TMMP of the present disclosure comprises Y84C and A139C substitutions. In some cases, the MOUSE H2K heavy chain polypeptide of a TMMP of the present disclosure comprises Y84C, A139C and A236C substitutions.

Exemplary Combinations

Table 1, below, presents various combinations of MHC Class I heavy chain sequence modifications that can be incorporated in a TMMP of the present disclosure.

TABLE 1

| Entry | HLA Heavy Chain Sequence | Sequence Identity Range % | Specific Substitutions at aa positions 84, 139 and/or 236 |
|---|---|---|---|
| 1 | HLA-A Consensus (FIG. 26B) | 75%-99.8%, 80%-99.8%, 85%-99.8%, 90%-99.8%, 95%-99.8%, 98%-99.8%, or 99%-99.8%; or 1-25, 1-5, 5-10, 10-15, 15-20, or 20-25 aa insertions, deletions, and/or substitutions (not counting variable residues) | None; Y84C; Y84A; A139C; A236C; (Y84A & A236C); (Y84C & A139C); or (Y84C, A139C & A236C) |
| 2 | A*0101, A*0201, A*0301, A*1101, A*2402, A*2301, A*2402, A*2407, | 75%-99.8%, 80%-99.8%,85%-99.8%, 90%-99.8%, 95%-99.8%, 98%-99.8%, or 99%-99.8%; or 1-25, 1-5, 5-10, 10-15, 15-20, or 20-25 aa insertions | None; Y84C; Y84A; A139C; A236C; (Y84A & A236C); (Y84C & A139C); or |

TABLE 1-continued

| Entry | HLA Heavy Chain Sequence | Sequence Identity Range % | Specific Substitutions at aa positions 84, 139 and/or 236 |
|---|---|---|---|
| | A*3303, or A*3401 (FIG. 26A) | deletions, and/or substitutions | (Y84C, A139C & A236C) |
| 3 | HLA-B Consensus (FIG. 27B) | 75%-99.8%, 80%-99.8%, 85%-99.8%, 90%-99.8%, 95%-99.8%, 98%-99.8%, or 99%-99.8%; or 1-25, 1-5, 5-10, 10-15, 15-20, or 20-25 aa insertions, deletions, and/or substitutions (not counting variable residues) | None; Y84C; Y84A; A139C; A236C; (Y84A & A236C); (Y84C & A139C); or (Y84C, A139C & A236C) |
| 4 | B*0702, B*0801, B*1502, B*3802, B*4001, B*4601, or B*5301 (FIG. 27A) | 75%-99.8%, 80%-99.8%, 85%-99.8%, 90%-99.8%, 95%-99.8%, 98%-99.8%, or 99%-99.8%; or 1-25, 1-5, 5-10, 10-15, 15-20, or 20-25 aa insertions, deletions, and/or substitutions | None; Y84C; Y84A; A139C; A236C; (Y84A & A236C); (Y84C & A139C); or (Y84C, A139C & A236C) |
| 5 | HLA-C Consensus (FIG. 28B) | 75%-99.8%, 80%-99.8%, 85%-99.8%, 90%-99.8%, 95%-99.8%, 98%-99.8%, or 99%-99.8%; or 1-25, 1-5, 5-10, 10-15, 15-20, or 20-25 aa insertions, deletions, and/or substitutions (not counting variable residues) | None; Y84C; Y84A; A139C; A236C; (Y84A & A236C); (Y84C & A139C); or (Y84C, A139C & A236C) |
| 6 | C*0102, C*0303, C*0304, C*0401, C*0602, C*0701, C*0801, or C*1502 (FIG. 28A) | 75%-99.8%, 80%-99.8%, 85%-99.8%, 90%-99.8%, 95%-99.8%, 98%-99.8%, or 99%-99.8%; or 1-25, 1-5, 5-10, 10-15, 15-20, or 20-25 aa insertions, deletions, and/or substitutions | None; Y84C; Y84A; A139C; A236C; (Y84A & A236C); (Y84C & A139C); or (Y84C, A139C & A236C) |
| 7 | HLA-E, F, or G Consensus (FIG. 29) | 75%-99.8%, 80%-99.8%, 85%-99.8%, 90%-99.8%, 95%-99.8%, 98%-99.8%, or 99%-99.8%; or 1-25, 1-5, 5-10, 10-15, 15-20, or 20-25 aa insertions, deletions, and/or substitutions (not counting variable residues) | None; Y84C; Y84A; A139C; A236C; (Y84A & A236C); (Y84C & A139C); or (Y84C, A139C & A236C) |
| 8 | MOUSE H2K (FIG. 25) | 75%-99.8%, 80%-99.8%, 85%-99.8%, 90%-99.8%, 95%-99.8%, 98%-99.8%, or 99%-99.8%; or 1-25, 1-5, 5-10, 10-15, 15-20, or 20-25 aa insertions, deletions, and/or substitutions | None; Y84C; Y84A; A139C; A236C; (Y84A & A236C); (Y84C & A139C); or (Y84C, A139C & A236C) |

% The Sequence Identity Range is the permissible range in sequence identity of a MHC-H polypeptide sequence incorporated into a TMMP relative to the corresponding portion of the sequences listed in FIG. 25-30 not counting the variable residues in the consensus sequences.

Beta-2 Microglobulin

A β2-microglobulin (β2M) polypeptide of a TMMP of the present disclosure can be a human β2M polypeptide, a non-human primate β2M polypeptide, a murine β2M polypeptide, and the like. In some instances, a β2M polypeptide comprises an amino acid sequence having at least 75%, at least 80%, at least 85%, at least 90%, at least 95%, at least 98%, at least 99%, or 100%, amino acid sequence identity to a β2M amino acid sequence depicted in FIG. 7. In some instances, a β2M polypeptide comprises an amino acid sequence having at least 75%, at least 80%, at least 85%, at least 90%, at least 95%, at least 98%, at least 99%, or 100%, amino acid sequence identity to amino acids 21 to 119 of a β2M amino acid sequence depicted in FIG. 7.

In some cases, a suitable β2M polypeptide comprises the following amino acid sequence:
IQRTPKIQVY SCHPAENGKS NFLNCYVSGF HPSDI-EVDLLKNGERIEKVE HSDLSFSKDW SFYLLYYTEF TPTEKDEYAC RVNHVTLSQP KIVKWDRDM (SEQ ID NO:56); and the HLA Class I heavy chain polypeptide comprises the following amino acid sequence:
GSHSMRYFFTSVSRPGRGEPRFIAVGYVDDT-QFVRFDSDAASQRMEPRAPWIEQ EGPEYWDGET-RKVKAHSQTHRVDL(aa1){C}(aa2)AGSHTVQRM-YGCDVGSDWR FLRGYHQYAYDGKDYIALKED-LRSW(aa3){C}(aa4))HKWEAAHVAEQLRAYLEG TCVEWLRRYLENGKETLQRTDAPKTHMTHHAVSD-HEATLRCWALSFYPAEITLT WQRDGEDQTQDTEL (aa5)(C)(aa6)QKWAAVVVPSGQEQRYTCHVQHEG-LPKPLT LRWEP (SEQ ID NO:313), where the cysteine residues indicated as {C} form an disulfide bond between the α1 and α2-1 helices and the (C) residue forms a disulfide bond with the β2M polypeptide cysteine at position 12. In the sequence above, "aa1" is "amino acid cluster 1"; "aa2" is "amino acid cluster 2"; "aa3" is "amino acid cluster 3"; "aa4" is "amino acid cluster 4"; "aa5" is "amino acid cluster 5"; and "aa6" is "amino acid cluster 6"; see, e.g., FIG. 25. Each occurrence of aa1, aa2, aa3, aa4, aa5, and aa6 is and independently selected to be 1-5 amino acid residues, wherein the amino acid residues are i) selected independently from any naturally occurring (e.g., encoded) amino acid or ii) any naturally occurring amino acid except proline or glycine.

In some cases, an MHC polypeptide comprises a single amino acid substitution relative to a reference MHC polypeptide (where a reference MHC polypeptide can be a wild-type MHC polypeptide), where the single amino acid substitution substitutes an amino acid with a cysteine (Cys) residue. Such cysteine residues, when present in an MHC polypeptide of a first polypeptide of a TMMP of the present disclosure, can form a disulfide bond with a cysteine residue present in a second polypeptide chain of a TMMP of the present disclosure.

In some cases, a first MHC polypeptide in a first polypeptide of a TMMP of the present disclosure, and/or the second MHC polypeptide in the second polypeptide of a TMMP of the present disclosure, includes an amino acid substitution to substitute an amino acid with a cysteine, where the substituted cysteine in the first MHC polypeptide forms a disulfide bond with a cysteine in the second MHC polypeptide, where a cysteine in the first MHC polypeptide forms a disulfide bond with the substituted cysteine in the second MHC polypeptide, or where the substituted cysteine in the first MHC polypeptide forms a disulfide bond with the substituted cysteine in the second MHC polypeptide.

For example, in some cases, one of following pairs of residues in an HLA β2-microglobulin and an HLA Class I heavy chain is substituted with cysteines (where residue numbers are those of the mature polypeptide): 1) β2M residue 12, HLA Class I heavy chain residue 236; 2) β2M residue 12, HLA Class I heavy chain residue 237; 3) β2M residue 8, HLA Class I heavy chain residue 234; 4) β2M residue 10, HLA Class I heavy chain residue 235; 5) β2M residue 24, HLA Class I heavy chain residue 236; 6) β2M residue 28, HLA Class I heavy chain residue 232; 7) β2M residue 98, HLA Class I heavy chain residue 192; 8) β2M residue 99, HLA Class I heavy chain residue 234; 9) β2M residue 3, HLA Class 1 heavy chain residue 120; 10) β2M residue 31, HLA Class 1 heavy chain residue 96; 11) β2M residue 53, HLA Class I heavy chain residue 35; 12) β2M residue 60, HLA Class I heavy chain residue 96; 13) β2M residue 60, HLA Class I heavy chain residue 122; 14) β2M residue 63, HLA Class I heavy chain residue 27; 15) β2M residue Arg3, HLA Class I heavy chain residue Gly120; 16) β2M residue His31, HLA Class I heavy chain residue Gln96; 17) β2M residue Asp53, HLA Class I heavy chain residue Arg35; 18) β2M residue Trp60, HLA Class I heavy chain residue Gln96; 19) β2M residue Trp60, HLA Class I heavy chain residue Asp122; 20) β2M residue Tyr63, HLA Class I heavy chain residue Tyr27; 21) β2M residue Lys6, HLA Class I heavy chain residue Glu232; 22) β2M residue Gln8, HLA Class I heavy chain residue Arg234; 23) β2M residue Tyr10, HLA Class I heavy chain residue Pro235; 24) β2M residue Ser11, HLA Class I heavy chain residue Gln242; 25) β2M residue Asn24, HLA Class I heavy chain residue Ala236; 26) β2M residue Ser28, HLA Class I heavy chain residue Glu232; 27) β2M residue Asp98, HLA Class 1 heavy chain residue His192; and 28) β2M residue Met99, HLA Class I heavy chain residue Arg234. The amino acid numbering of the MHC/HLA Class I heavy chain is in reference to the mature MHC/HLA Class I heavy chain, without a signal peptide. For example, in some cases, residue 236 of the mature HLA-A amino acid sequence is substituted with a Cys. In some cases, residue 236 of the mature HLA-B amino acid sequence is substituted with a Cys. In some cases, residue 236 of the mature HLA-C amino acid sequence is substituted with a Cys. In some cases, residue 32 (corresponding to Arg-12 of mature β2M) of an amino acid sequence depicted in FIG. 8 is substituted with a Cys.

In some cases, a β2M polypeptide comprises the amino acid sequence: IQRTPKIQVY S<u>R</u>HPAENGKS NFLN-CYVSGF HPSDIEVDLLKNGERIEKVE HSDLSFSKDW SFYLLYYTEF TPTEKDEYAC RVNHVTLSQP KIVKW-DRDM (SEQ ID NO:55). In some cases, a β2M polypeptide comprises the amino acid sequence: IQRTPKIQVY S <u>C</u>HPAENGKS NFLNCYVSGF HPSDIEVDLLKNGE- RIEKVE HSDLSFSKDW SFYLLYYTEF TPTEKDEYAC RVNHVTLSQP KIVKWDRDM (SEQ ID NO:56).

In some cases, an HLA Class I heavy chain polypeptide comprises the amino acid sequence:

(SEQ ID NO: 53)
GSHSMRYFFTSVSRPGRGEPRFIAVGYVDDTQFVRFDSDAASQRMEPRAPW

IEQEGPEYWDGETRKVKAHSQTHRVDLGTLRGYYNQSEAGSHTVQRMYGCD

VGSDWRFLRGYHQYAYDGKDYIALKEDLRSWTAADMAAQTTKHKWEAAHVA

EQLRAYLEGTCVEWLRRYLENGKETLQRTDAPKTHMTHHAVSDHEATLRCW

ALSFYPAEITLTWQRDGEDQTQDTELVETRP<u>A</u>GDGTFQKWAAVVVPSGQEQ

RYTCHVQHEGLPKPLTLRWEP.

In some cases, an HLA Class I heavy chain polypeptide comprises the amino acid sequence:

(SEQ ID NO: 57)
GSHSMRYFFTSVSRPGRGEPRFIAVGYVDDTQFVRFDSDAASQRMEPRAPW

IEQEGPEYWDGETRKVKAHSQTHRVDLGTLRGYYNQSEAGSHTVQRMYGCD

VGSDWRFERGYHQYAYDGKDYIALKEDLRSWTAADMAAQTTKHKWEAAHVA

EQLRAYLEGTCVEWLRRYLENGKETLQRTDAPKTHMTHHAVSDHEATLRCW

ALSFYPAEITETWQRDGEDQTQDTELVETRP<u>C</u>GDGTFQKWAAVVVPSGQEQ

RYTCHVQHEGLPKPLTLRWEP.

In some cases, an HLA Class I heavy chain polypeptide comprises the amino acid sequence:

(SEQ ID NO: 58)
GSHSMRYFFTSVSRPGRGEPRFIAVGYVDDTQFVRFDSDAASQRMEPRAPW

IEQEGPEYWDGETRKVKAHSQTHRVDLGTLRG<u>A</u>YNQSEAGSHTVQRMYGCD

VGSDWRFLRGYHQYAYDGKDYIALKEDLRSWTAADMAAQTTKHKWEAAHVA

EQLRAYLEGTCVEWLRRYLENGKETLQRTDAPKTHMTHHAVSDHEATLRCW

ALSFYPAEITLTWQRDGEDQTQDTELVETRP<u>C</u>GDGTFQKWAAVVVPSGQEQ

RYTCHVQHEGLPKPLTLRWE.

In some cases, the β2M polypeptide comprises the following amino acid sequence:

(SEQ ID NO: 56)
IQRTPKIQVY S<u>C</u>HPAENGKS NFLNCYVSGF HPSDIEVDLLKNGERIE

KVE HSDLSFSKDW SFYLLYYTEF TPTEKDEYAC RVNHVTLSQP

KIVKWDRDM;

and the HLA Class I heavy chain polypeptide of a TMMP of the present disclosure comprises the following amino acid sequence:

(SEQ ID NO: 57)
GSHSMRYFFTSVSRPGRGEPRFIAVGYVDDTQFVRFDSDAASQRMEPRAP

WIEQEGPEYWDGETRKVKAHSQTHRVDLGTLRGYYNQSEAGSHTVQRMYG

CDVGSDWRFLRGYHQYAYDGKDYIALKEDLRSWTAADMAAQTTKHKWEAA

HVAEQLRAYLEGTCVEWLRRYLENGKETLQRTDAPKTHMTHHAVSDHEAT

-continued

LRCWALSFYPAEITLTWQRDGEDQTQDTELVETRPCGDGTFQKWAAVVVP

SGQEQRYTCHVQHEGLPKPLTLRWEP, where the Cys residues that are underlined and in bold form a disulfide bond with one another in the TMMP.

In some cases, the β2M polypeptide comprises the amino acid sequence:

(SEQ ID NO: 56)
IQRTPKIQVYSCHPAENGKSNFLNCYVSGFHPSDIEVDLLKNGERIEKVEH

SDLSFSKDWSFYLLYYTEFTPTEKDEYACRVNHVTLSQPKIVKWDRDM.

Figure 3A:
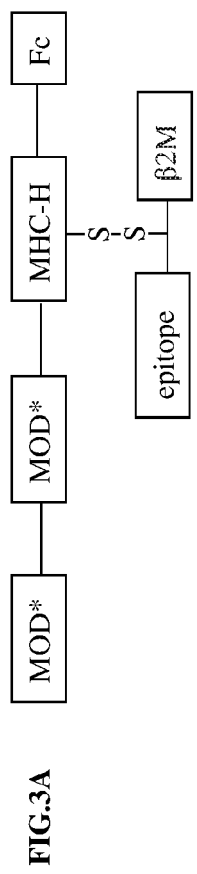
Figure 3B:
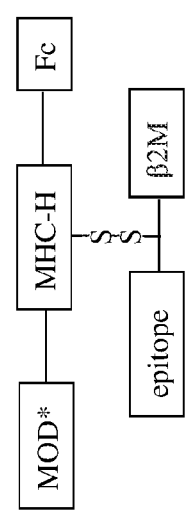
Figure 3C:
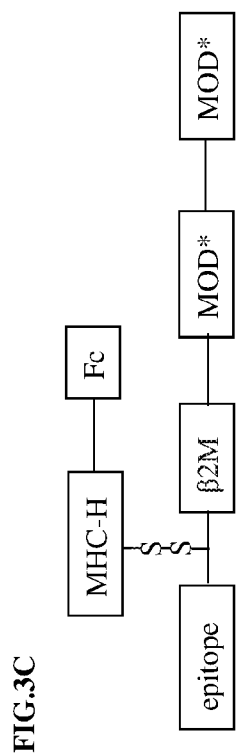

In some cases, the first polypeptide and the second polypeptide of a TMMP of the present disclosure are disulfide linked to one another through: i) a Cys residue present in a linker connecting the peptide epitope and a β2M polypeptide in the first polypeptide chain; and ii) a Cys residue present in an MHC Class I heavy chain in the second polypeptide chain. In some cases, the Cys residue present in the MHC Class I heavy chain is a Cys introduce as a Y84C substitution. In some cases, the linker connecting the peptide epitope and the β2M polypeptide in the first polypeptide chain is GCGGS(G4S)n (SEQ ID NO:235), where n is 1, 2, 3, 4, 5, 6, 7, 8, or 9. For example, in some cases, the linker comprises the amino acid sequence GCGGSGGGGSGGGGSGGGGS (SEQ ID NO:236). As another example, the linker comprises the amino acid sequence GCGGSGGGGSGGGGS (SEQ ID NO:237). Examples of disulfide-linked first and second polypeptides of a TMMP of the present disclosure are depicted schematically in FIG. 3A-3F.

Scaffold Polypeptides

A TMMP of the present disclosure can comprise an Fc polypeptide, or can comprise another suitable scaffold polypeptide.

Suitable scaffold polypeptides include antibody-based scaffold polypeptides and non-antibody-based scaffolds. Non-antibody-based scaffolds include, e.g., albumin, an XTEN (extended recombinant) polypeptide, transferrin, an Fc receptor polypeptide, an elastin-like polypeptide (see, e.g., Hassouneh et al. (2012) *Methods Enzymol.* 502:215; e.g., a polypeptide comprising a pentapeptide repeat unit of (Val-Pro-Gly-X-Gly; SEQ ID NO:59), where X is any amino acid other than proline), an albumin-binding polypeptide, a silk-like polypeptide (see, e.g., Valluzzi et al. (2002) *Philos Trans R Soc Lond B Biol Sci.* 357:165), a silk-elastin-like polypeptide (SELP; see, e.g., Megeed et al. (2002) *Adv Drug Deliv Rev.* 54:1075), and the like. Suitable XTEN polypeptides include, e.g., those disclosed in WO 2009/023270, WO 2010/091122, WO 2007/103515, US 2010/0189682, and US 2009/0092582; see also Schellenberger et al. (2009) *Nat Biotechnol.* 27:1186). Suitable albumin polypeptides include, e.g., human serum albumin.

Suitable scaffold polypeptides will in some cases be a half-life extending polypeptides. Thus, in some cases, a suitable scaffold polypeptide increases the in vivo half-life (e.g., the serum half-life) of the multimeric polypeptide, compared to a control multimeric polypeptide lacking the scaffold polypeptide. For example, in some cases, a scaffold polypeptide increases the in viva half-life (e.g., the serum half-life) of the multimeric polypeptide, compared to a control multimeric polypeptide lacking the scaffold polypeptide, by at least about 10%, at least about 15%, at least about 20%, at least about 25%, at least about 50%, at least about 2-fold, at least about 2.5-fold, at least about 5-fold, at least about 10-fold, at least about 25-fold, at least about 50-fold, at least about 100-fold, or more than 100-fold. As an example, in some cases, an Fc polypeptide increases the in vivo half-life (e.g., the serum half-life) of the multimeric polypeptide, compared to a control multimeric polypeptide lacking the Fc polypeptide, by at least about 10%, at least about 15%, at least about 20%, at least about 25%, at least about 50%, at least about 2-fold, at least about 2.5-fold, at least about 5-fold, at least about 10-fold, at least about 25-fold, at least about 50-fold, at least about 100-fold, or more than 100-fold.

Fc Polypeptides

In some cases, the first and/or the second polypeptide chain of a multimeric polypeptide (e.g., a TMMP of the present disclosure) comprises an Fc polypeptide. The Fc polypeptide of a multimeric polypeptide can be a human IgG1 Fc, a human IgG2 Fc, a human IgG3 Fc, a human IgG4 Fc, etc. In some cases, the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to an amino acid sequence of an Fc region depicted in FIG. 5A-5G. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG1 Fc polypeptide depicted in FIG. 5A. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG1 Fc polypeptide depicted in FIG. 5A; and comprises a substitution of N77; e.g., the Fc polypeptide comprises an N77A substitution. In some cases, the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to the human IgG2 Fc polypeptide depicted in FIG. 5A; e.g., the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to amino acids 99-325 of the human IgG2 Fc polypeptide depicted in FIG. 5A. In some cases, the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to the human IgG3 Fc polypeptide depicted in FIG. 5A; e.g., the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to amino acids 19-246 of the human IgG3 Fc polypeptide depicted in FIG. 5A. In some cases, the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to the human IgM Fc polypeptide depicted in FIG. 5B; e.g., the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to amino acids 1-276 to the human IgM Fc polypeptide depicted in FIG. 5B. In some cases, the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to the human IgA Fc polypeptide depicted in FIG. 5C; e.g., the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to amino acids 1-234 to the human IgA Fc polypeptide depicted in FIG. 5C.

In some cases, the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to the human IgG4 Fc polypeptide depicted in FIG. 5C. In some cases, the Fc polypeptide comprises an amino acid sequence having at least about 70%, at least about 75%, at least about 80%, at least about 85%, at least about 90%, at least about 95%, at least about 98%, at least about 99%, or 100%, amino acid sequence identity to amino acids 100 to 327 of the human IgG4 Fc polypeptide depicted in FIG. 5C.

In some cases, the IgG4 Fc polypeptide comprises the following amino acid sequence:

(SEQ ID NO: 312)
PPCPSCPAPEFLGGPSVFLFPPKPKDTLMISRTPEVTCVVVDVSQEDPEVQ

FNWYVDGVEVHNAKTKPREEQFNSTYRVVSVLTVLHQDWLNGKEYKCKVSN

KGLPSSIEKTISKAKGQPREPQVYTLPPSQEEMTKNQVSLTCLVKGFYPSD

IAVEWESNGQPENNYKTTPPVLDSDGSFFLYSRLTVDKSRWQEGNVFSCSV

MHEALHNHYTQKSLSLSPG.

In some cases, the Fc polypeptide present in a TMMP comprises the amino acid sequence depicted in FIG. 5A (human IgG1 Fc). In some cases, the Fc polypeptide present in a TMMP comprises the amino acid sequence depicted in FIG. 5A (human IgG1 Fc), except for a substitution of N297 (N77 of the amino acid sequence depicted in FIG. 5A) with an amino acid other than asparagine. In some cases, the Fc polypeptide present in a TMMP comprises the amino acid sequence depicted in FIG. 5C (human IgG1 Fc comprising an N297A substitution, which is N77 of the amino acid sequence depicted in FIG. 5A). In some cases, the Fc polypeptide present in a TMMP comprises the amino acid sequence depicted in FIG. 5A (human IgG1 Fc), except for a substitution of L234 (L14 of the amino acid sequence depicted in FIG. 5A) with an amino acid other than leucine. In some cases, the Fc polypeptide present in a TMMP comprises the amino acid sequence depicted in FIG. 5A (human IgG1 Fc), except for a substitution of L235 (L15 of the amino acid sequence depicted in FIG. 5A) with an amino acid other than leucine.

In some cases, the Fc polypeptide present in a TMMP comprises the amino acid sequence depicted in FIG. 5E. In some cases, the Fc polypeptide present in a TMMP comprises the amino acid sequence depicted in FIG. 5F. In some cases, the Fc polypeptide present in a TMMP comprises the amino acid sequence depicted in FIG. 5G (human IgG1 Fc comprising an L234A substitution and an L235A substitution, corresponding to positions 14 and 15 of the amino acid sequence depicted in FIG. 5G). In some cases, the Fc polypeptide present in a TMMP comprises the amino acid sequence depicted in FIG. 5A (human IgG1 Fc), except for a substitution of P331 (P111 of the amino acid sequence depicted in FIG. 5A) with an amino acid other than proline; in some cases, the substitution is a P331S substitution. In some cases, the Fc polypeptide present in a TMMP comprises the amino acid sequence depicted in FIG. 5A (human IgG1 Fc), except for substitutions at L234 and L235 (L14 and L15 of the amino acid sequence depicted in FIG. 5A) with amino acids other than leucine. In some cases, the Fc polypeptide present in a TMMP comprises the amino acid sequence depicted in FIG. 5A (human IgG1 Fc), except for substitutions at L234 and L235 (L14 and L15 of the amino acid sequence depicted in FIG. 5A) with amino acids other than leucine, and a substitution of P331 (P111 of the amino acid sequence depicted in FIG. 5A) with an amino acid other than proline. In some cases, the Fc polypeptide present in a TMMP comprises the amino acid sequence depicted in FIG. 5E (human IgG1 Fc comprising L234F, L235E, and P331S substitutions (corresponding to amino acid positions 14, 15, and 111 of the amino acid sequence depicted in FIG. 5E). In some cases, the Fc polypeptide present in a TMMP is an IgG1 Fc polypeptide that comprises L234A and L235A substitutions (substitutions of L14 and L15 of the amino acid sequence depicted in FIG. 5A with Ala), as depicted in FIG. 5G.

Linkers

A TMMP of the present disclosure can include one or more linkers, where the one or more linkers are between one or more of: i) an MHC Class I or Class II polypeptide and an Ig Fc polypeptide, where such a linker is referred to herein as "L1"; ii) an immunomodulatory polypeptide and an MHC Class I or Class II polypeptide, where such a linker is referred to herein as "L2"; iii) a first immunomodulatory polypeptide and a second immunomodulatory polypeptide, where such a linker is referred to herein as "L3"; iv) a peptide antigen ("epitope") and an MHC Class I or Class II polypeptide; v) an MHC Class I or Class II polypeptide and a dimerization polypeptide (e.g., a first or a second member of a dimerizing pair); and vi) a dimerization polypeptide (e.g., a first or a second member of a dimerizing pair) and an IgFc polypeptide.

Suitable linkers (also referred to as "spacers") can be readily selected and can be of any of a number of suitable lengths, such as from 1 amino acid to 25 amino acids, from 3 amino acids to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids. A suitable linker can be 1, 2, 3, 4, 5, 6, 7, 8, 9, 10, 11, 12, 13, 14, 15, 16, 17, 18, 19, 20, 21, 22, 23, 24, or 25 amino acids in length. In some cases, a linker has a length of from 25 amino acids to 50 amino acids, e.g., from 25 to 30, from 30 to 35, from 35 to 40, from 40 to 45, or from 45 to 50 amino acids in length.

Exemplary linkers include glycine polymers $(G)_n$, glycine-serine polymers (including, for example, $(GS)_n$, $(GSGGS)_n$ (SEQ ID NO:60) and $(GGGS)_n$ (SEQ ID NO:61), where n is an integer of at least one), glycine-alanine polymers, alanine-serine polymers, and other flexible linkers known in the art. Glycine and glycine-serine polymers can be used; both Gly and Ser are relatively unstructured, and therefore can serve as a neutral tether between components. Glycine polymers can be used; glycine accesses significantly more phi-psi space than even alanine, and is much less restricted than residues with longer side chains (see Scheraga, *Rev. Computational Chem.* 11173-142 (1992)). Exemplary linkers can comprise amino acid sequences including, but not limited to, GGSG (SEQ ID NO:62), GGSGG (SEQ ID NO:63), GSGSG (SEQ ID NO:64), GSGGG (SEQ ID NO:65), GGGSG (SEQ ID NO:66), GSSSG (SEQ ID NO:67), and the like. Exemplary linkers can include, e.g., Gly(Ser$_4$)n, where n is 1, 2, 3, 4, 5, 6, 7, 8, 9, or 10. In some cases, a linker comprises the amino acid sequence (GSSSS)n (SEQ ID NO:68), where n is 4. In some cases, a linker comprises the amino acid sequence (GSSSS)n (SEQ ID NO:68), where n is 5. In some cases, a linker comprises the amino acid sequence (GGGGS)n (SEQ ID NO:69), where n is 1. In some cases, a linker comprises the amino acid sequence (GGGGS)n (SEQ ID NO:69), where n is 2. In some cases, a linker comprises the amino acid sequence (GGGGS)n (SEQ ID NO:69), where n is 3. In some cases, a linker comprises the amino acid sequence (GGGGS)n (SEQ ID NO:69), where n is 4. In some cases, a linker comprises the amino acid sequence (GGGGS)n (SEQ ID NO:69), where n is 5. In some cases, a linker comprises the amino acid sequence (GGGGS)n (SEQ ID NO:69), where n is 6. In some cases, a linker comprises the amino acid sequence (GGGGS)n (SEQ ID NO:69), where n is 7. In some cases, a linker comprises the amino acid sequence (GGGGS)n (SEQ ID NO:69), where n is 8. In some cases, a linker comprises the amino acid sequence (GGGGS)n (SEQ ID NO:69), where n is 9. In some cases, a linker comprises the amino acid sequence (GGGGS)n (SEQ ID NO:69), where n is 10. In some cases, a linker comprises the amino acid sequence AAAGG (SEQ ID NO:70).

In some cases, a linker polypeptide, present in a first polypeptide of a multimeric polypeptide of the present disclosure, includes a cysteine residue that can form a disulfide bond with a cysteine residue present in a second polypeptide of a multimeric polypeptide of the present disclosure. In some cases, for example, a suitable linker comprises the amino acid sequence GCGASGGGGSGGGGS (SEQ ID NO:71). As another example, a suitable linker can comprise the amino acid sequence GCGGS(G4S)n (SEQ ID NO:235), where n is 1, 2, 3, 4, 5, 6, 7, 8, or 9. For example, in some cases, the linker comprises the amino acid sequence GCGGSGGGGSGGGGSGGGGS (SEQ ID NO:236). As another example, the linker comprises the amino acid sequence GCGGSGGGGSGGGGS (SEQ ID NO:237).

Epitopes

An epitope present in a multimeric polypeptide (e.g., a TMMP of the present disclosure) can have a length of from about 4 amino acids to about 25 amino acids, e.g., the epitope can have a length of from 4 amino acids (aa) to 10 aa, from 10 aa to 15 aa, from 15 aa to 20 aa, or from 20 aa to 25 aa. For example, an epitope present in a multimeric polypeptide of the present disclosure can have a length of 4 amino acids (aa), 5 aa, 6 aa, 7, aa, 8 aa, 9 aa, 10 aa, 11 aa, 12 aa, 13 aa, 14 aa, 15 aa, 16 aa, 17 aa, 18 aa, 19 aa, 20 aa, 21 aa, 22 aa, 23 aa, 24 aa, or 25 aa. In some cases, an epitope present in a multimeric polypeptide has a length of from 5 amino acids to 10 amino acids, e.g., 5 aa, 6 aa, 7 aa, 8 aa, 9 aa, or 10 aa.

An epitope present in a multimeric polypeptide (e.g., a TMMP of the present disclosure) is a peptide specifically bound by a T-cell, i.e., the epitope is specifically bound by an epitope-specific T cell. An epitope-specific T cell binds an epitope having a reference amino acid sequence, but does not substantially bind an epitope that differs from the reference amino acid sequence. For example, an epitope-specific T cell binds an epitope having a reference amino acid sequence, and binds an epitope that differs from the reference amino acid sequence, if at all, with an affinity that is less than $10^{-6}$ M, less than $10^{-5}$ M, or less than $10^{-4}$ M. An epitope-specific T cell can hind an epitope for which it is specific with an affinity of at least $10^{-7}$ M, at least $10^{-8}$ M, at least $10^{-9}$ M, or at least $10^{-10}$ M.

Suitable epitopes include: i) epitopes present in a cancer-associate antigen; ii) epitopes present in or produced by an infectious disease agent; and iii) autoimmune epitopes.

Suitable epitopes include, but are not limited to, epitopes present in a cancer-associated antigen. Cancer-associated antigens are known in the art; see, e.g., Cheever et al. (2009) *Clin. Cancer Res.* 15:5323. Cancer-associated antigens include, but are not limited to, α-folate receptor; carbonic anhydrase IX (CAIX); CD19; CD20; CD22; CD30; CD33; CD44v7/8; carcinoembryonic antigen (CEA); epithelial glycoprotein-2 (EGP-2); epithelial glycoprotein-40 (EGP-40); folate binding protein (FBP); fetal acetylcholine receptor; ganglioside antigen GD2; Her2/neu; IL-13R-a2; kappa light chain; LeY; L1 cell adhesion molecule; melanoma-associated antigen (MAGE); MAGE-A1; mesothelin; MUC1; NKG2D ligands; oncofetal antigen (h5T4); prostate stem cell antigen (PSCA); prostate-specific membrane antigen (PSMA); tumor-associate glycoprotein-72 (TAG-72); vascular endothelial growth factor receptor-2 (VEGF-R2). See, e.g., Vigneron et al. (2013) *Cancer Immunity* 13:15; and Vigneron (2015) *BioMed Res. Int'l* Article ID 948501; and epidermal growth factor receptor (EGFR) vIII polypeptide (see, e.g., Wong et al. (1992) *Proc. Natl. Acad. Sci. USA* 89:2965; and Miao et al. (2014) *PLoSOne* 9:e94281). In some cases, the epitope is a human papilloma virus E7 antigen epitope; see, e.g., Ramos et al. (2013) *J. Immunother.* 36:66.

In some cases, a suitable peptide epitope is a peptide fragment of from about 4 amino acids to about 20 amino acids (e.g., 4 amino acids (aa), 5 aa, 6 aa, 7 aa, 8 aa, 9 aa, 10 aa, 11 aa, 12 aa, 13 aa, 14 aa, 15 aa, 16 aa, 17 aa, 18 aa, 19 aa, or 20 aa) in length of a MUC1 polypeptide, a human papillomavirus (HPV) E6 polypeptide, an LMP2 polypeptide, an HPV E7 polypeptide, an epidermal growth factor receptor (EGFR) vIII polypeptide, a HER-2/neu polypeptide, a melanoma antigen family A, 3 (MAGE A3) polypeptide, a p53 polypeptide, a mutant p53 polypeptide, an NY-ESO-1 polypeptide, a folate hydrolase (prostate-specific membrane antigen; PSMA) polypeptide, a carcinoembryonic antigen (CEA) polypeptide, a melanoma antigen recognized by T-cells (melanA/MART1) polypeptide, a Ras polypeptide, a gp100 polypeptide, a proteinase3 (PR1) polypeptide, a bcr-abl polypeptide, a tyrosinase polypeptide, a survivin polypeptide, a prostate specific antigen (PSA) polypeptide, an hTERT polypeptide, a sarcoma translocation breakpoints polypeptide, a synovial sarcoma X (SSX) breakpoint polypeptide, an EphA2 polypeptide, an acid phosphatase, prostate (PAP) polypeptide, a melanoma inhibitor of apoptosis (ML-IAP) polypeptide, an alpha-fetoprotein (AFP) polypeptide, an epithelial cell adhesion molecule (EpCAM) polypeptide, an ERG (TMPRSS2 ETS fusion) polypeptide, a NA17 polypeptide, a paired-box-3 (PAX3) polypeptide, an anaplastic lymphoma kinase (ALK) polypeptide, an androgen receptor polypeptide, a cyclin B1 polypeptide, an N-myc proto-oncogene (MYCN) polypeptide, a Ras homolog gene family member C (RhoC) polypeptide, a tyrosinase-related protein-2 (TRP-2) polypeptide, a mesothelin polypeptide, a prostate stem cell antigen (PSCA) polypeptide, a melanoma associated antigen-1 (MAGE A1) polypeptide, a cytochrome P450 1B1 (CYP1B1) polypeptide, a placenta-specific protein 1 (PLAC1) polypeptide, a BORIS polypeptide (also known as CCCTC-binding factor or CTCF), an ETV6-AML polypeptide, a breast cancer antigen NY-BR-1 polypeptide (also referred to as ankyrin repeat domain-containing protein 30A), a regulator of G-protein signaling (RGS5) polypeptide, a squamous cell carcinoma antigen recognized by T-cells (SART3) polypeptide, a carbonic anhydrase IX polypeptide, a paired box-5 (PAX5) polypeptide, an OY-TES1 (testis antigen; also known as acrosin binding protein) polypeptide, a sperm protein 17 polypeptide, a lymphocyte cell-specific protein-tyrosine kinase (LCK) polypeptide, a high molecular weight melanoma associated antigen (HMW-MAA), an A-kinase anchoring protein-4 (AKAP-4), a synovial sarcoma X breakpoint 2 (SSX2) polypeptide, an X antigen family member 1 (XAGE1) polypeptide, a B7 homolog 3 (B7H3; also known as CD276) polypeptide, a legumain polypeptide (LGMN1; also known as asparaginyl endopeptidase), a tyrosine kinase with Ig and EGF homology domains-2 (Tie-2; also known as angiopoietin-1 receptor) polypeptide, a P antigen family member 4 (PAGE4) polypeptide, a vascular endothelial growth factor receptor 2 (VEGF2) polypeptide, a MAD-CT-1 polypeptide, a fibroblast activation protein (FAP) polypeptide, a platelet derived growth factor receptor beta (PDGFβ) polypeptide, a MAD-CT-2 polypeptide, a Fos-related antigen-1 (FOSL) polypeptide, or a Wilms tumor-1 (WT-1) polypeptide.

Amino acid sequences of cancer-associated antigens are known in the art; see, e.g., MUC1 (GenBank CAA56734); LMP2 (GenBank CAA47024); HPV E6 (GenBank AAD33252); HPV E7 (GenBank AHG99480); EGFRvIII (GenBank NP_001333870); HER-2/neu (GenBank AAI67147); MAGE-A3 (GenBank AAH11744); p53 (GenBank BAC16799); NY-ESO-1 (GenBank CAA05908); PSMA (GenBank AAH25672); CEA (GenBank AAA51967); melan/MART1 (GenBank NP_005502); Ras (GenBank NP_001123914); gp100 (GenBank AAC60634); bcr-abl (GenBank AAB60388); tyrosinase (GenBank AAB60319); survivin (GenBank AAC51660); PSA (GenBank CAD54617); hTERT (GenBank BAC11010); SSX (GenBank NP_001265620); Eph2A (GenBank NP_004422); PAP (GenBank AAH16344); ML-IAP (GenBank AAH14475); AFP (GenBank NP_001125); EpCAM (GenBank NP_002345); ERG (TMPRSS2 ETS fusion) (GenBank ACA81385); PAX3 (GenBank AAI01301); ALK (GenBank NP_004295); androgen receptor (GenBank NP_000035); cyclin B1 (GenBank CAO99273); MYCN (GenBank NP_001280157); RhoC (GenBank AAH52808); TRP-2 (GenBank AAC60627); mesothelin (GenBank AAH09272); PSCA (GenBank AAH65183); MAGE A1 (GenBank NP_004979); CYP1B1 (GenBank AAM50512); PLAC1 (GenBank AAG22596); BORIS (GenBank NP_001255969); ETV6 (GenBank NP_001978); NY-BR1 (GenBank NP_443723); SART3 (GenBank NP_055521); carbonic anhydrase IX (GenBank EAW58359); PAX5 (GenBank NP_057953); OY-TES1 (GenBank NP_115878); sperm protein 17 (GenBank AAK20878); LCK (GenBank NP_001036236); HMW-MAA (GenBank NP_001888); AKAP-4 (GenBank NP_003877); SSX2 (GenBank CAA60111); XAGE1 (GenBank NP_001091073; XP_001125834; XP_001125856; and XP_001125872); B7H3 (GenBank NP_001019907; XP_947368; XP_950958; XP_950960; XP_950962; XP_950963; XP_950965; and XP_950967); LGMN1 (GenBank NP_001008530); TIE-2 (GenBank NP_000450); PAGE4 (GenBank NP_001305806); VEGFR2 (GenBank NP_002244); MAD-CT-1 (GenBank NP_005893 NP_056215); FAP (GenBank NP_004451); PDGFβ (GenBank NP_002600); MAD-CT-2 (GenBank NP_001138574); FOSL (GenBank NP_005429); and WT-1 (GenBank NP_000369). These polypeptides are also discussed in, e.g., Cheever et al. (2009) *Clin. Cancer Res.* 15:5323, and references cited therein; Wagner et al. (2003) *J. Cell. Sci.* 116:1653; Matsui et al. (1990) *Oncogene* 5:249; Zhang et al. (1996) *Nature* 383:168.

In some cases, the epitope is HPV16E7/82-90 (LLMGTLGIV; SEQ ID NO:72). In some cases, the epitope is HPV16E7/86-93 (TLGIVCPI; SEQ ID NO:73). In some cases, the epitope is HPV16E7/11-20 (YMLDLQPETT; SEQ ID NO:74). In some cases, the epitope is HPV16E7/11-19 (YMLDLQPET; SEQ ID NO:75). See, e.g., Ressing et al. ((1995) *J. Immunol.* 154:5934) for additional suitable HPV epitopes.

In some cases, the epitope is an epitope of an infectious disease agent. In some cases, the epitope is a viral epitope.

For example, in some cases, the viral epitope is a hepatitis B virus (HBV) epitope. The HBV epitope can be an HBV peptide epitope derived from HBV polymerase, HBV envelope, HBV precore, or HBV X-protein. In some cases, the HBV epitope is an HBV Core peptide. For example, an HBV Core peptide can have the amino acid sequence: FLPSDFFPSV (SEQ ID NO:238). In some cases, the HBV epitope is an HBV polymerase (Pol) peptide. Suitable HBV Pol peptides include, e.g., GLSRYVARLG (SEQ ID NO:239), KLHLYSHPI (SEQ ID NO:240); FLLSLGIHL (SEQ ID NO:241), ALMPLYACI (SEQ ID NO:242), and SLYADSPSV (SEQ ID NO:243). Suitable HBV peptides include: FLPSDFFPSV (SEQ ID NO:238), GLSRYVARLG (SEQ ID NO:239), KLHLYSHPI (SEQ ID NO:240), FLLSLGIHL (SEQ ID NO:241), ALMPLYACI (SEQ ID NO:242), SLYADSPSV (SEQ ID NO:243), STLPETTVV (SEQ ID NO:314), LIMPARFYPK (SEQ ID NO:315), AIMPARFYPK (SEQ ID NO:316), YVNVNMGLK (SEQ ID NO:317), PLGFFPDH (SEQ ID NO:318), MQWNSTALHQALQDP (SEQ ID NO:319), LLDPRVRGL (SEQ ID NO:320), SILSKTGDPV (SEQ ID NO:321), VLQAGFFLL (SEQ ID NO:322), FLLTRILTI (SEQ ID NO:323), FLGGTPVCL (SEQ ID NO:324), LLCLIFLLV (SEQ ID NO:325), LVLLDYQGML (SEQ ID NO:326), LLDYQGMLPV (SEQ ID NO:327), IPIPSSWAF (SEQ ID NO:328), WLSLLVPFV (SEQ ID NO:329), GLSPTVWLSV (SEQ ID NO:330), SIVSPFIPLL (SEQ ID NO:331), ILSPFLPLL (SEQ ID NO:332), ATVELLSFLPSDFFPSV (SEQ ID NO:333), LPSDFFPSV (SEQ ID NO:334), CLTFGRETV (SEQ ID NO:335), VLEYLVSFGV (SEQ ID NO:336), EYLVSFGVW (SEQ ID NO:337), ILSTLPETTV (SEQ ID NO:338), STLPETTVVRR (SEQ ID NO:339), NVSIPWTHK (SEQ ID NO:340), KVGNFTGLY (SEQ ID NO:341), GLYSSTVPV (SEQ ID NO:342), TLWKAGILYK (SEQ ID NO:343), TPARVTGGVF (SEQ ID NO:344), LVVDFSQFSR (SEQ ID NO:345), GLSRYVARL (SEQ ID NO:346), SIACSVVRR (SEQ ID NO:347), YMDDVVLGA (SEQ ID NO:348), ALMPLYACI (SEQ ID NO:242), QAFTFSPTYK (SEQ ID NO:349), KYTSFPWLL (SEQ ID NO:350), ILRGTSFVYV (SEQ ID NO:351), HLSLRGLFV (SEQ ID NO:352), VLHKRTLGL (SEQ ID NO:353), GLSAMSTTDL (SEQ ID NO:354), CLFKDWEEL (SEQ ID NO:355), and VLGGCRHKL (SEQ ID NO:356), where the peptide has a length of from 9 amino acids to 19 amino acids (e.g., 9, 10, 11, 12, 13, 14, 15, 16, 17, 18, or 19 amino acids).

In some cases, the HBV epitope is a peptide of one of the sequences depicted in Table 2.

TABLE 2

| Sequence | Length in aa residues | SEQ ID NO. |
|---|---|---|
| FLPSDFFPSV from HBV core protein | 10-12 | 238 |
| GLSRYVARLG from HBV polymerase | 10-12 | 239 |
| KLHLYSHPI from HBV polymerase | 9-11 | 240 |
| FLLSLGIHL from HBV polymerase | 9-11 | 241 |
| ALMPLYACI from HBV polymerase | 9-11 | 242 |
| SLYADSPSV from HBV polymerase | 9-11 | 243 |
| STLPETTVV | 9-11 | 314 |
| LIMPARFYPK | 10-12 | 315 |
| AIMPARFYPK | 10-12 | 316 |
| YVNVNMGLK | 9-11 | 317 |
| PLGFFPDH | 8-10 | 318 |
| MQWNSTALHQALQDP | 15-17 | 319 |
| LLDPRVRGL | 9-11 | 320 |
| SILSKTGDPV | 10-12 | 321 |
| VLQAGFFLL | 9-11 | 322 |
| FLLTRILTI | 9-11 | 323 |
| FLGGTPVCL | 9-11 | 324 |
| LLCLIFLLV | 9-11 | 325 |
| LVLLDYQGML | 10-11 | 326 |
| LLDYQGMLPV | 10-12 | 327 |
| IPIPSSWAF | 9-11 | 328 |
| WLSLLVPFV | 9-11 | 329 |
| GLSPTVWLSV | 10-12 | 330 |
| SIVSPFIPLL | 9-11 | 331 |
| ILSPFLPLL | 9-11 | 332 |
| ATVELLSFLPSDFFPSV | 17-19 | 333 |
| LPSDFFPSV | 9-11 | 334 |
| CLTFGRETV | 9-11 | 335 |
| VLEYLVSFGV | 10-12 | 336 |
| EYLVSFGVW | 9-11 | 337 |
| ILSTLPETTV | 10-12 | 338 |
| STLPETTVVRR | 11-13 | 339 |
| NVSIPWTHK | 9-11 | 340 |
| KVGNFTGLY | 9-11 | 341 |
| GLYSSTVPV | 9-11 | 342 |

TABLE 2-continued

| Sequence | Length in aa residues | SEQ ID NO. |
|---|---|---|
| TLWKAGILYK | 10-12 | 343 |
| TPARVTGGVF | 10-12 | 344 |
| LVVDFSQFSR | 10-12 | 345 |
| GLSRYVARL | 9-11 | 346 |
| SIACSVVRR | 9-11 | 347 |
| YMDDVVLGA | 9-11 | 348 |
| ALMPLYACI | 9-11 | 242 |
| QAFTFSPTYK | 9-11 | 349 |
| KYTSFPWLL | 9-11 | 350 |
| ILRGTSFVYV | 10-12 | 351 |
| HLSLRGLFV | 9-11 | 352 |
| VLHKRTLGL | 9-11 | 353 |
| GLSAMSTTDL | 10-12 | 354 |
| CLFKDWEEL | 9-11 | 355 |
| VLGGCRHKL | 9-11 | 356 |

Immunomodulatory Polypeptides

Suitable immunomodulatory domains that exhibit reduced affinity for a co-immunomodulatory domain can have from 1 amino acid (aa) to 20 aa differences from a wild-type immunomodulatory domain. For example, in some cases, a variant immunomodulatory polypeptide present in a TMMP of the present disclosure differs in amino acid sequence by 1 aa, 2 aa, 3 aa, 4 aa, 5 aa, 6 aa, 7 aa, 8 aa, 9 aa, or 10 aa, from a corresponding wild-type immunomodulatory polypeptide. As another example, in some cases, a variant immunomodulatory polypeptide present in a TMMP of the present disclosure differs in amino acid sequence by 11 aa, 12 aa, 13 aa, 14 aa, 15 aa, 16 aa, 17 aa, 18 aa, 19 aa, or 20 aa, from a corresponding wild-type immunomodulatory polypeptide. As an example, in some cases, a variant immunomodulatory polypeptide present in a TMMP of the present disclosure includes 1, 2, 3, 4, 5, 6, 7, 8, 9, or 10 amino acid substitutions, compared to a corresponding reference (e.g., wild-type) immunomodulatory polypeptide. In some cases, variant immunomodulatory polypeptide present in a TMMP of the present disclosure includes a single amino acid substitution compared to a corresponding reference (e.g., wild-type) immunomodulatory polypeptide. In some cases, variant immunomodulatory polypeptide present in a TMMP of the present disclosure includes 2 amino acid substitutions (e.g., no more than 2 amino acid substitutions) compared to a corresponding reference (e.g., wild-type) immunomodulatory polypeptide. In some cases, variant immunomodulatory polypeptide present in a TMMP of the present disclosure includes 3 amino acid substitutions (e.g., no more than 3 amino acid substitutions) compared to a corresponding reference (e.g., wild-type) immunomodulatory polypeptide. In some cases, variant immunomodulatory polypeptide present in a TMMP of the present disclosure includes 4 amino acid substitutions (e.g., no more than 4 amino acid substitutions) compared to a corresponding reference (e.g., wild-type) immunomodulatory polypeptide. In some cases, variant immunomodulatory polypeptide present in a TMMP of the present disclosure includes 5 amino acid substitutions (e.g., no more than 5 amino acid substitutions) compared to a corresponding reference (e.g., wild-type) immunomodulatory polypeptide. In some cases, variant immunomodulatory polypeptide present in a TMMP of the present disclosure includes 6 amino acid substitutions (e.g., no more than 6 amino acid substitutions) compared to a corresponding reference (e.g., wild-type) immunomodulatory polypeptide. In some cases, variant immunomodulatory polypeptide present in a TMMP of the present disclosure includes 7 amino acid substitutions (e.g., no more than 7 amino acid substitutions) compared to a corresponding reference (e.g., wild-type) immunomodulatory polypeptide. In some cases, variant immunomodulatory polypeptide present in a TMMP of the present disclosure includes 8 amino acid substitutions (e.g., no more than 8 amino acid substitutions) compared to a corresponding reference (e.g., wild-type) immunomodulatory polypeptide. In some cases, variant immunomodulatory polypeptide present in a TMMP of the present disclosure includes 9 amino acid substitutions (e.g., no more than 9 amino acid substitutions) compared to a corresponding reference (e.g., wild-type) immunomodulatory polypeptide. In some cases, variant immunomodulatory polypeptide present in a TMMP of the present disclosure includes 10 amino acid substitutions (e.g., no more than 10 amino acid substitutions) compared to a corresponding reference (e.g., wild-type) immunomodulatory polypeptide.

In some cases, variant immunomodulatory polypeptide present in a TMMP of the present disclosure includes 11 amino acid substitutions (e.g., no more than 11 amino acid substitutions) compared to a corresponding reference (e.g., wild-type) immunomodulatory polypeptide. In some cases, variant immunomodulatory polypeptide present in a TMMP of the present disclosure includes 12 amino acid substitutions (e.g., no more than 12 amino acid substitutions) compared to a corresponding reference (e.g., wild-type) immunomodulatory polypeptide. In some cases, variant immunomodulatory polypeptide present in a TMMP of the present disclosure includes 13 amino acid substitutions (e.g., no more than 13 amino acid substitutions) compared to a corresponding reference (e.g., wild-type) immunomodulatory polypeptide. In some cases, variant immunomodulatory polypeptide present in a TMMP of the present disclosure includes 14 amino acid substitutions (e.g., no more than 14 amino acid substitutions) compared to a corresponding reference (e.g., wild-type) immunomodulatory polypeptide. In some cases, variant immunomodulatory polypeptide present in a TMMP of the present disclosure includes 15 amino acid substitutions (e.g., no more than 15 amino acid substitutions) compared to a corresponding reference (e.g., wild-type) immunomodulatory polypeptide. In some cases, variant immunomodulatory polypeptide present in a TMMP of the present disclosure includes 16 amino acid substitutions (e.g., no more than 16 amino acid substitutions) compared to a corresponding reference (e.g., wild-type) immunomodulatory polypeptide. In some cases, variant immunomodulatory polypeptide present in a TMMP of the present disclosure includes 17 amino acid substitutions (e.g., no more than 17 amino acid substitutions) compared to a corresponding reference (e.g., wild-type) immunomodulatory polypeptide. In some cases, variant immunomodulatory polypeptide present in a TMMP of the present disclosure includes 18 amino acid substitutions (e.g., no more than 18 amino acid substitutions) compared to a corresponding reference (e.g., wild-type) immunomodulatory polypeptide. In some cases, variant immunomodulatory polypeptide present in a TMMP of the present disclosure includes 19 amino acid substitutions (e.g., no more than 19 amino acid substitutions) compared to a corresponding reference (e.g., wild-type) immunomodulatory polypeptide. In some cases, variant immunomodulatory polypeptide present in a TMMP of the present disclosure includes 20 amino acid substitutions (e.g., no more than 20 amino acid substitutions) compared to a corresponding reference (e.g., wild-type) immunomodulatory polypeptide.

As discussed above, a variant immunomodulatory polypeptide suitable for inclusion in a TMMP of the present disclosure exhibits reduced affinity for a cognate co-immunomodulatory polypeptide, compared to the affinity of a corresponding wild-type immunomodulatory polypeptide for the cognate co-immunomodulatory polypeptide.

Exemplary pairs of immunomodulatory polypeptide and cognate co-immunomodulatory polypeptide include, but are not limited to:

a) 4-1BBL (immunomodulatory polypeptide) and 4-1BB (cognate co-immunomodulatory polypeptide);

b) PD-L1 (immunomodulatory polypeptide) and PD1 (cognate co-immunomodulatory polypeptide);

c) IL-2 (immunomodulatory polypeptide) and IL-2 receptor (cognate co-immunomodulatory polypeptide);

d) CD80 (immunomodulatory polypeptide) and CD28 (cognate co-immunomodulatory polypeptide);

e) CD86 (immunomodulatory polypeptide) and CD28 (cognate co-immunomodulatory polypeptide);

f) OX40L (CD252) (immunomodulatory polypeptide) and OX40 (CD134) (cognate co-immunomodulatory polypeptide);

g) Fas ligand (immunomodulatory polypeptide) and Fas (cognate co-immunomodulatory polypeptide);

h) ICOS-L (immunomodulatory polypeptide) and ICOS (cognate co-immunomodulatory polypeptide);

i) ICAM (immunomodulatory polypeptide) and LFA-1 (cognate co-immunomodulatory polypeptide);

j) CD30L (immunomodulatory polypeptide) and CD30 (cognate co-immunomodulatory polypeptide);

k) CD40 (immunomodulatory polypeptide) and CD40L (cognate co-immunomodulatory polypeptide);

l) CD83 (immunomodulatory polypeptide) and CD83L (cognate co-immunomodulatory polypeptide);

m) HVEM (CD270) (immunomodulatory polypeptide) and CD160 (cognate co-immunomodulatory polypeptide);

n) JAG1 (CD339) (immunomodulatory polypeptide) and Notch (cognate co-immunomodulatory polypeptide);

o) JAG1 (immunomodulatory polypeptide) and CD46 (cognate co-immunomodulatory polypeptide);

p) CD80 (immunomodulatory polypeptide) and CTLA4 (cognate co-immunomodulatory polypeptide); and q) CD86 (immunomodulatory polypeptide) and CTLA4 (cognate co-immunomodulatory polypeptide).

In some cases, a variant immunomodulatory polypeptide present in a T-cell modulatory multimeric polypeptide of the present disclosure has a binding affinity for a cognate co-immunomodulatory polypeptide that is from 100 nM to 100 μM. For example, in some cases, a variant immunomodulatory polypeptide present in a T-cell modulatory multimeric polypeptide of the present disclosure has a binding affinity for a cognate co-immunomodulatory polypeptide that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 µM, to about 1 µM to about 5 µM, from about 5 µM to about 10 µM, from about 10 µM to about 15 µM, from about 15 µM to about 20 µM, from about 20 µM to about 25 µM, from about 25 µM to about 50 µM, from about 50 µM to about 75 µM, or from about 75 µM to about 100 µM.

A variant immunomodulatory polypeptide present in a T-cell modulatory multimeric polypeptide of the present disclosure exhibits reduced affinity for a cognate co-immunomodulatory polypeptide. Similarly, a T-cell modulatory multimeric polypeptide of the present disclosure that comprises a variant immunomodulatory polypeptide exhibits reduced affinity for a cognate co-immunomodulatory polypeptide. Thus, for example, a T-cell modulatory multimeric polypeptide of the present disclosure that comprises a variant immunomodulatory polypeptide has a binding affinity for a cognate co-immunomodulatory polypeptide that is from 100 nM to 100 µM. For example, in some cases, a T-cell modulatory multimeric polypeptide of the present disclosure that comprises a variant immunomodulatory polypeptide has a binding affinity for a cognate co-immunomodulatory polypeptide that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 µM, to about 1 µM to about 5 µM, from about 5 µM to about 10 µM, from about 10 µM to about 15 µM, from about 15 µNI to about 20 µM, from about 20 µM to about 25 µM, from about 25 µM to about 50 µM, from about 50 µM to about 75 µM, or from about 75 µM to about 100 µM.

PD-L1 Variants

As one non-limiting example, in some cases, a variant immunomodulatory polypeptide present in a T-cell modulatory multimeric polypeptide of the present disclosure is a variant PD-L1 polypeptide. Wild-type PD-L1 binds to PD1.

A wild-type human PD-L1 polypeptide can comprise the following amino acid sequence: MRIFAVFIFM TYWHLLNAFT VTVPKDLYVV EYGSNMTIEC KFPVEKQLDL AALIVYWEME DKNIIQFVHG EEDLKVQHSS YRQRARLLKD QLSLGNAALQ ITDVKLQDAG VYRCMISYGG ADYKRITVKV NAPYNKINQR ILVVDPVTSE HELTCQAEGY PKAEVIWTSS DHQVLSGKTT TTNSKREEKL FNVTSTLRIN TTTNEIFYCT FRRLDPEENH TAELVIPGNI LNVSIKICLT LSPST (SEQ ID NO:1).

A wild-type human PD-L1 ectodomain can comprise the following amino acid sequence: FT VTVPKDLYVV EYGSNMTIEC KFPVEKQLDL AALIVYWEME DKNIIQFVHG EEDLKVQHSS YRQRARLLKD QLSLGNAALQ ITDVKLQDAG VYRCMISYGG ADYKRITVKV NAPYNKINQR ILVVDPVTSE HELTCQAEGY PKAEVIWTSS DHQVLSGKTT TTNSKREEKL FNVTSTLRIN TTTNEIFYCT FRRLDPEENH TAELVIPGNI LNVSIKI (SEQ ID NO:2).

A wild-type PD-1 polypeptide can comprise the following amino acid sequence: PGWFLDSPDR PWNPPTFSPA LLVVTEGDNA TFTCSFSNTS ESFVLNWYRM SPSNQTDKLA AFPEDRSQPG QDCRFRVTQL PNGRDFHMSV VRARRNDSGT YLCGAISLAP KAQIKESLRA ELRVTERRAE VPTAHPSPSP RPAGQFQTLV VGVVGGLLGS LVLLVWVLAV ICSRAARGTI GARRTGQPLK EDPSAVPVFS VDY- GELDFQW REKTPEPPVP CVPEQTEYAT IVFPSGMGTS SPARRGSADG PRSAQPLRPE DGHCSWPL (SEQ ID NO:3). In some cases, where a T-cell modulatory multimeric polypeptide of the present disclosure comprises a variant PD-L1 polypeptide, a "cognate co-immunomodulatory polypeptide" is a PD-1 polypeptide comprising the amino acid sequence of SEQ ID NO:3.

In some cases, a variant PD-L1 polypeptide exhibits reduced binding affinity to PD-1 (e.g., a PD-1 polypeptide comprising the amino acid sequence set forth in SEQ ID NO:3), compared to the binding affinity of a PD-L1 polypeptide comprising the amino acid sequence set forth in SEQ ID NO:1 or SEQ ID NO:2. For example, in some cases, a variant PD-L1 polypeptide of the present disclosure binds PD-1 (e.g., a PD-1 polypeptide comprising the amino acid sequence set forth in SEQ ID NO:3) with a binding affinity that is at least 10%, at least 15%, at least 20%, at least 25%, at least 30%, at least 35%, at least 40%, at least 45%, at least 50% less, at least 55% less, at least 60% less, at least 65% less, at least 70% less, at least 75% less, at least 80% less, at least 85% less, at least 90% less, at least 95% less, or more than 95% less, than the binding affinity of a PD-L1 polypeptide comprising the amino acid sequence set forth in SEQ ID NO:1 or SEQ ID NO:2.

In some cases, a variant PD-L1 polypeptide has a binding affinity to PD-1 that is from 1 nM to 1 mM. In some cases, a variant PD-L1 polypeptide of the present disclosure has a binding affinity to PD-1 that is from 100 nM to 100 µM. As another example, in some cases, a variant PD-L1 polypeptide has a binding affinity for PD1 (e.g., a PD1 polypeptide comprising the amino acid sequence set forth in SEQ ID NO:3) that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 µM, to about 1 µM to about 5 µM, from about 5 µM to about 10 µM, from about 10 µM to about 15 µM, from about 15 µM to about 20 µM, from about 20 µM to about 25 µM, from about 25 µM to about 50 µM, from about 50 µM to about 75 µM, or from about 75 µM to about 100 µM.

In some cases, a variant PD-L1 polypeptide has a single amino acid substitution compared to the PD-L1 amino acid sequence set forth in SEQ ID NO:1 or SEQ ID NO:2. In some cases, a variant PD-L1 polypeptide has from 2 to 10 amino acid substitutions compared to the PD-L1 amino acid sequence set forth in SEQ ID NO:1 or SEQ ID NO:2. In some cases, a variant PD-L1 polypeptide has 2 amino acid substitutions compared to the PD-L1 amino acid sequence set forth in SEQ ID NO:1 or SEQ ID NO:2. In some cases, a variant PD-L1 polypeptide has 3 amino acid substitutions compared to the PD-L1 amino acid sequence set forth in SEQ ID NO:1 or SEQ ID NO:2. In some cases, a variant PD-L1 polypeptide has 4 amino acid substitutions compared to the PD-L1 amino acid sequence set forth in SEQ ID NO:1 or SEQ ID NO:2. In some cases, a variant PD-L1 polypeptide has 5 amino acid substitutions compared to the PD-L1 amino acid sequence set forth in SEQ ID NO:1 or SEQ ID NO:2. In some cases, a variant PD-L1 polypeptide has 6 amino acid substitutions compared to the PD-L1 amino acid sequence set forth in SEQ ID NO:1 or SEQ ID NO:2. In some cases, a variant PD-L1 polypeptide has 7 amino acid substitutions compared to the PD-L1 amino acid sequence set forth in SEQ ID NO:1 or SEQ ID NO:2. In some cases, a variant PD-L1 polypeptide has 8 amino acid substitutions compared to the PD-L1 amino acid sequence set forth in SEQ ID NO:1 or SEQ ID NO:2. In some cases, a variant PD-L1 polypeptide has 9 amino acid substitutions compared to the PD-L1 amino acid sequence set forth in SEQ ID NO:1 or SEQ ID NO:2. In some cases, a variant PD-L1 polypeptide has 10 amino acid substitutions compared to the PD-L1 amino acid sequence set forth in SEQ ID NO:1 or SEQ ID NO:2.

A suitable PD-L1 variant includes a polypeptide that comprises an amino acid sequence having at least 90%, at least 95%, at least 98%, at least 99%, or 100%, amino acid sequence identity to the following amino acid sequence:

FT VTVPKXLYVV EYGSNMTIEC KFPVEKQLDL AALIVYWEME DKNIIQFVHG EEDLKVQHSS YRQRARLLKD QLSLGNAALQ ITDVKLQDAG VYRCMISYGG ADYKRITVKV NAPYNKINQR ILVVDPVTSE HELTCQAEGY PKAEVIWTSS DHQVLSGKTT TTNSKREEKL FNVTSTLRIN TTTNEI-FYCT FRRLDPEENH TAELVIPGNI LNVSIKI (SEQ ID NO:76), where X is any amino acid other than Asp. In some cases, X is Ala. In some cases, X is Arg.

A suitable PD-L1 variant includes a polypeptide that comprises an amino acid sequence having at least 90%, at least 95%, at least 98%, at least 99%, or 100%, amino acid sequence identity to the following amino acid sequence:

FT VTVPKDLYVV EYGSNMTIEC KFPVEKQLDL AALXVYWEME DKNIIQFVHG EEDLKVQHSS YRQRARLLKD QLSLGNAALQ ITDVKLQDAG VYRCMISYGG ADYKRITVKV NAPYNKINQR ILVVDPVTSE HELTCQAEGY PKAEVIWTSS DHQVLSGKTT TTNSKREEKL FNVTSTLRIN TTTNEI-FYCT FRRLDPEENH TAELVIPGNI LNVSIKI (SEQ ID NO:77), where X is any amino acid other than Ile. In some cases, X is Asp.

A suitable PD-L1 variant includes a polypeptide that comprises an amino acid sequence having at least 90%, at least 95%, at least 98%, at least 99%, or 100%, amino acid sequence identity to the following amino acid sequence:

FT VTVPKDLYVV EYGSNMTIEC KFPVEKQLDL AALIVYWEME DKNIIQFVHG EXDLKVQHSS YRQRARLLKD QLSLGNAALQ ITDVKLQDAG VYRCMISYGG ADYKRITVKV NAPYNKINQR ILVVDPVTSE HELTCQAEGY PKAEVIWTSS DHQVLSGKTT TTNSKREEKL FNVTSTLRIN TTTNEI-FYCT FRRLDPEENH TAELVIPGNI LNVSIKI (SEQ ID NO:78), where X is any amino acid other than Glu. In some cases, X is Arg.

CD80 Variants

In some cases, a variant immunomodulatory polypeptide present in a T-cell modulatory multimeric polypeptide of the present disclosure is a variant CD80 polypeptide. Wild-type CD80 binds to CD28. Wild-type CD80 also binds to CTLA4.

A wild-type amino acid sequence of the ectodomain of human CD80 can be as follows:

(SEQ ID NO: 4)
VIHVTK EVKEVATLSC GHNVSVEELA QTRIYWQKEK KMVLTMMSGD

MNIWPEYKNR TIFDITNNLS IVILALRPSD EGTYECVVLK

YEKDAFKREH LAEVTLSVKA DFPTPSISDF EIPTSNIRRI

ICSTSGGFPE PHLSWLENGE ELNAINTTVS QDPETELYAV

SSKLDFNMTT NHSFMCLIKY GHLRVNQTFN WNTTKQEHFP DN.

A wild-type CD28 amino acid sequence can be as follows: MLRLLLALNL FPSIQVTGNK ILVKQSPMLV AYD-NAVNLSC KYSYNLFSRE FRASLHKGLD SAVEVCV-VYG NYSQQLQVYS KTGFNCDGKL GNESVTFYLQ NLYVNQTDIY FCKIEVMYPP PYLDNEKSNG TIIHVKGKHL CPSPLFPGPS KPFWVLVVVG GVLA-CYSLLV TVAFIIFWVR SKRSRLLHSD YMNMTPRRPG PTRKHYQPYA PPRDFAAYRS (SEQ ID NO:5). In some cases, where a T-cell modulatory multimeric polypeptide of the present disclosure comprises a variant CD80 polypeptide, a "cognate co-immunomodulatory polypeptide" is a CD28 polypeptide comprising the amino acid sequence of SEQ ID NO:5.

A wild-type CD28 amino acid sequence can be as follows: MLRLLLALNL FPSIQVTGNK ILVKQSPMLV AYD-NAVNLSW KHLCPSPLFP GPSKPFWVLV VVGGVLA-CYS LLVTVAFIIF WVRSKRSRLL HSDYMNMTPR RPGPTRKHYQ PYAPPRDFAA YRS (SEQ ID NO:6)

A wild-type CD28 amino acid sequence can be as follows: MLRLLLALNL FPSIQVTGKH LCPSPLFPGP SKPFWVLVVV GGVLACYSLL VTVAFIIFWV RSKRSRLLHS DYMNMTPRRP GPTRKHYQPY APPRDFAAYR S (SEQ ID NO:7).

In some cases, a variant CD80 polypeptide exhibits reduced binding affinity to CD28, compared to the binding affinity of a CD80 polypeptide comprising the amino acid sequence set forth in SEQ ID NO:4 for CD28. For example, in some cases, a variant CD80 polypeptide binds CD28 with a binding affinity that is at least 10%, at least 15%, at least 20%, at least 25%, at least 30%, at least 35%, at least 40%, at least 45%, at least 50% less, at least 55% less, at least 60% less, at least 65% less, at least 70% less, at least 75% less, at least 80% less, at least 85% less, at least 90% less, at least 95% less, or more than 95% less, than the binding affinity of a CD80 polypeptide comprising the amino acid sequence set forth in SEQ ID NO:4 for CD28 (e.g., a CD28 polypeptide comprising the amino acid sequence set forth in one of SEQ ID NO:5, 6, or 7).

In some cases, a variant CD80 polypeptide has a binding affinity to CD28 that is from 100 nM to 100 µM. As another example, in some cases, a variant CD80 polypeptide of the present disclosure has a binding affinity for CD28 (e.g., a CD28 polypeptide comprising the amino acid sequence set forth in SEQ ID NO:5, SEQ ID NO:6, or SEQ ID NO:7) that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 µM, to about 1 µM to about 5 µM, from about 5 µM to about 10 µM, from about 10 µM to about 15 µM, from about 15 µM to about 20 µM, from about 20 µM to about 25 µM, from about 25 µM to about 50 µM, from about 50 µM to about 75 µM, or from about 75 µM to about 100 µM.

In some cases, a variant CD80 polypeptide has a single amino acid substitution compared to the CD80 amino acid sequence set forth in SEQ ID NO:4. In some cases, a variant CD80 polypeptide has from 2 to 10 amino acid substitutions compared to the CD80 amino acid sequence set forth in SEQ ID NO:4. In some cases, a variant CD80 polypeptide has 2 amino acid substitutions compared to the CD80 amino acid sequence set forth in SEQ ID NO:4. In some cases, a variant CD80 polypeptide has 3 amino acid substitutions compared to the CD80 amino acid sequence set forth in SEQ ID NO:4.

In some cases, a variant CD80 polypeptide has 4 amino acid substitutions compared to the CD80 amino acid sequence set forth in SEQ ID NO:4. In some cases, a variant CD80 polypeptide has 5 amino acid substitutions compared to the CD80 amino acid sequence set forth in SEQ ID NO:4. In some cases, a variant CD80 polypeptide has 6 amino acid substitutions compared to the CD80 amino acid sequence set forth in SEQ ID NO:4. In some cases, a variant CD80 polypeptide has 7 amino acid substitutions compared to the CD80 amino acid sequence set forth in SEQ ID NO:4. In some cases, a variant CD80 polypeptide has 8 amino acid substitutions compared to the CD80 amino acid sequence set forth in SEQ ID NO:4. In some cases, a variant CD80 polypeptide has 9 amino acid substitutions compared to the CD80 amino acid sequence set forth in SEQ ID NO:4. In some cases, a variant CD80 polypeptide has 10 amino acid substitutions compared to the CD80 amino acid sequence set forth in SEQ ID NO:4.

Suitable CD80 variants include a polypeptide that comprises an amino acid sequence having at least 90%, at least 95%, at least 98%, at least 99%, or 100%, amino acid sequence identity to any one of the following amino acid sequences:

VIHVTK EVKEVATLSC GHXVSVEELA QTRIYWQKEK KMVLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:79), where X is any amino acid other than Asn. In some cases, X is Ala;

VIHVTK EVKEVATLSC GHNVSVEELA QTRIYWQKEK KMVLTMMSGD MNIWPEYKNR TIFDITXNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:80), where X is any amino acid other than Asn. In some cases, X is Ala;

VIHVTK EVKEVATLSC GHNVSVEELA QTRIYWQKEK KMVLTMMSGD MNIWPEYKNR TIFDITNNLS XVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:81), where X is any amino acid other than Ile. In some cases, X is Ala;

VIHVTK EVKEVATLSC GHNVSVEELA QTRIYWQKEK KMVLTMMSGD MNIWPEYKNR TIFDITNNLS IVILALRPSD EGTYECVVLX YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:82), where X is any amino acid other than Lys. In some cases, X is Ala;

VIHVTK EVKEVATLSC GHNVSVEELA QTRIYWQKEK KMVLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS XDPETELYAV SSKLDFNMTT NHSFMCLIKY GHLRVNQTFN WNTTKQEHFP DN (SEQ ID NO:83), where X is any amino acid other than Gln. In some cases, X is Ala;

VIHVTK EVKEVATLSC GHNVSVEELA QTRIYWQKEK KMVLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QXPETELYAV SSKLDFNMTT NHSFMCLIKY GHLRVNQTFN WNTTKQEHFP DN (SEQ ID NO:84), where X is any amino acid other than Asp. In some cases, X is Ala;

VIHVTK EVKEVATLSC GHNVSVEEXA QTRIYWQKEK KMVLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:85), where X is any amino acid other than Leu. In some cases, X is Ala;

VIHVTK EVKEVATLSC GHNVSVEELA QTRI XWQKEK KMVLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:86), where X is any amino acid other than Tyr. In some cases, X is Ala;

VIHVTK EVKEVATLSC GHNVSVEELA QTRIYW XKEK KMVLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:87), where X is any amino acid other than Gln. In some cases, X is Ala;

VIHVTK EVKEVATLSC GHNVSVEELA QTRIYWQKEK KXVLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:88), where X is any amino acid other than Met. In some cases, X is Ala;

VIHVTK EVKEVATLSC GHNVSVEELA QTRIYWQKEK KMXLTMMSGD MNIWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:89), where X is any amino acid other than Val. In some cases, X is Ala;

VIHVTK EVKEVATLSC GHNVSVEELA QTRIYWQKEK KMVLTMMSGD MNXWPEYKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:90), where X is any amino acid other than Ile. In some cases, X is Ala;

VIHVTK EVKEVATLSC GHNVSVEELA QTRIYWQKEK KMVLTMMSGD MNIWPEXKNR TIFDITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETELYAV SSKLDFNMTT NHSFMCLIKY GHLRVNQTFN WNTTKQEHFP DN (SEQ ID NO:91), where X is any amino acid other than Tyr. In some cases, X is Ala;

VIHVTK EVKEVATLSC GHNVSVEELA QTRIYWQKEK KMVLTMMSGD MNIWPEYKNR TIF XITNNLS IVILALRPSD EGTYECVVLK YEKDAFKREH LAEVTLSVKA DFPTPSISDF EIPTSNIRRI ICSTSGGFPE PHLSWLENGE ELNAINTTVS QDPETE-

LYAV SSKLDFNMTT NHSFMCLIKY GHLRVNQTFN WNTTKQEHFP DN (SEQ ID NO:92), where X is any amino acid other than Asp. In some cases, X is Ala;

VIHVTK EVKEVATLSC GHNVSVEELA QTRIYWQKEK KMVLTMMSGD MNIWPEYKNR TIFDITNNLS IVILALRPSD EGTYECVVLK YEK-DAFKREH LAEVTLSVKA D<u>X</u>PTPSISDF EIPTSNIRRI ICSTSGGFPE PHLSWLENGE ELNAINTTVS QDPETE-LYAV SSKLDFNMTT NHSFMCLIKY GHLRVNQTFN WNTTKQEHFP DN (SEQ ID NO:93), where X is any amino acid other than Phe. In some cases, X is Ala;

VIHVTK EVKEVATLSC GHNVSVEELA QTRIYWQKEK KMVLTMMSGD MNIWPEYKNR TIFDITNNLS IVILALRPSD EGTYECVVLK YEK-DAFKREH LAEVTLSVKA DFPTPSISDF EIPTSNIRRI ICSTSGGFPE PHLSWLENGE ELNAINTTV<u>X</u> QDPETE-LYAV SSKLDFNMTT NHSFMCLIKY GHLRVNQTFN WNTTKQEHFP DN (SEQ ID NO:94), where X is any amino acid other than Ser. In some cases, X is Ala; and V IHVTK EV KEVATLSC GHNVSVEELA QTRIYWQKEK KMVLTMMSGD MNIWPEYKNR TIFDITNNLS IVILALRPSD EGTYECVVLK YEK-DAFKREH LAEVTLSVKA DFPT<u>X</u>SISDF EIPTSNIRRI ICSTSGGFPE PHLSWLENGE ELNAINTTVS QDPETE-LYAV SSKLDFNMTT NHSFMCLIKY GHLRVNQTFN WNTTKQEHFP DN (SEQ ID NO:95), where X is any amino acid other than Pro. In some cases, X is Ala.

CD86 Variants

In some cases, a variant immunomodulatory polypeptide present in a T-cell modulatory multimeric polypeptide of the present disclosure is a variant CD86 polypeptide. Wild-type CD86 binds to CD28. In some cases, where a T-cell modulatory multimeric polypeptide of the present disclosure comprises a variant CD86 polypeptide, a "cognate co-immunomodulatory polypeptide" is a CD28 polypeptide comprising the amino acid sequence of SEQ ID NO:5.

The amino acid sequence of the full ectodomain of a wild-type human CD86 can be as follows:

(SEQ ID NO: 8)
APLKIQAYFNETADLPCQFANSQNQSLSELVVFWQDQENLVLNEVYLGKE

KFDSVHSKYM<u>N</u>RTS<u>F</u>DSD<u>W</u>TLRLHNLQIKDKGLYQCII<u>HH</u>KKPTGMIRI

HQMNSELSV<u>L</u>ANFSQPEIVPISNITENVYINLTCSSIHGYPEPKKMSVLL

RTKNSTIEYDGIMQKSQDNVTELYDVSISLSVSFPDVTSNMTIFCILETD

KTRLLSSPFSIELEDPQPPPDHIP.

The amino acid sequence of the IgV domain of a wild-type human CD86 can be as follows:

(SEQ ID NO: 9)
APLKIQAYFNETADLPCQFANSQNQSLSELVVFWQDQENLVLNEVYLGKE

KFDSVHSKYM<u>N</u>RTS<u>F</u>DSD<u>W</u>TLRLHNLQIKDKGLYQCII<u>HH</u>KKPTGMIRI

HQMNSELSVL.

In some cases, a variant CD86 polypeptide exhibits reduced binding affinity to CD28, compared to the binding affinity of a CD86 polypeptide comprising the amino acid sequence set forth in SEQ ID NO:8 or SEQ ID NO:9 for CD28. For example, in some cases, a variant CD86 polypeptide binds CD28 with a binding affinity that is at least 10%, at least 15%, at least 20%, at least 25%, at least 30%, at least 35%, at least 40%, at least 45%, at least 50% less, at least 55% less, at least 60% less, at least 65% less, at least 70% less, at least 75% less, at least 80% less, at least 85% less, at least 90% less, at least 95% less, or more than 95% less, than the binding affinity of a CD86 polypeptide comprising the amino acid sequence set forth in SEQ ID NO:8 or SEQ ID NO:9 for CD28 (e.g., a CD28 polypeptide comprising the amino acid sequence set forth in one of SEQ ID NO:5, 6, or 7).

In some cases, a variant CD86 polypeptide has a binding affinity to CD28 that is from 100 nM to 100 μM. As another example, in some cases, a variant CD86 polypeptide of the present disclosure has a binding affinity for CD28 (e.g., a CD28 polypeptide comprising the amino acid sequence set forth in one of SEQ ID NOs:5, 6, or 7) that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 μM, to about 1 μM to about 5 μM, from about 5 μM to about 10 μM, from about 10 μM to about 15 μM, from about 15 μM to about 20 μM, from about 20 μM to about 25 μM, from about 25 μM to about 50 μM, from about 50 μM to about 75 μM, or from about 75 μM to about 100 μM.

In some cases, a variant CD86 polypeptide has a single amino acid substitution compared to the CD86 amino acid sequence set forth in SEQ ID N0:8. In some cases, a variant CD86 polypeptide has from 2 to 10 amino acid substitutions compared to the CD86 amino acid sequence set forth in SEQ ID NO:8. In some cases, a variant CD86 polypeptide has 2 amino acid substitutions compared to the CD86 amino acid sequence set forth in SEQ ID NO:8. In some cases, a variant CD86 polypeptide has 3 amino acid substitutions compared to the CD86 amino acid sequence set forth in SEQ ID NO:8. In some cases, a variant CD86 polypeptide has 4 amino acid substitutions compared to the CD86 amino acid sequence set forth in SEQ ID NO:8. In some cases, a variant CD86 polypeptide has 5 amino acid substitutions compared to the CD86 amino acid sequence set forth in SEQ ID NO:8. In some cases, a variant CD86 polypeptide has 6 amino acid substitutions compared to the CD86 amino acid sequence set forth in SEQ ID NO:8. In some cases, a variant CD86 polypeptide has 7 amino acid substitutions compared to the CD86 amino acid sequence set forth in SEQ ID NO:8. In some cases, a variant CD86 polypeptide has 8 amino acid substitutions compared to the CD86 amino acid sequence set forth in SEQ ID NO:8. In some cases, a variant CD86 polypeptide has 9 amino acid substitutions compared to the CD86 amino acid sequence set forth in SEQ ID NO:8. In some cases, a variant CD86 polypeptide has 10 amino acid substitutions compared to the CD86 amino acid sequence set forth in SEQ ID NO:8.

In some cases, a variant CD86 polypeptide has a single amino acid substitution compared to the CD86 amino acid sequence set forth in SEQ ID NO:9. In some cases, a variant CD86 polypeptide has from 2 to 10 amino acid substitutions compared to the CD86 amino acid sequence set forth in SEQ ID NO:9. In some cases, a variant CD86 polypeptide has 2 amino acid substitutions compared to the CD86 amino acid sequence set forth in SEQ ID NO:9. In some cases, a variant CD86 polypeptide has 3 amino acid substitutions compared to the CD86 amino acid sequence set forth in SEQ ID NO:9. In some cases, a variant CD86 polypeptide has 4 amino acid substitutions compared to the CD86 amino acid sequence set forth in SEQ ID NO:9. In some cases, a variant CD86 polypeptide has 5 amino acid substitutions compared to the CD86 amino acid sequence set forth in SEQ ID NO:9. In some cases, a variant CD86 polypeptide has 6 amino acid substitutions compared to the CD86 amino acid sequence set forth in SEQ ID NO:9. In some cases, a variant CD86 polypeptide has 7 amino acid substitutions compared to the CD86 amino acid sequence set forth in SEQ ID NO:9. In some cases, a variant CD86 polypeptide has 8 amino acid substitutions compared to the CD86 amino acid sequence set forth in SEQ ID NO:9. In some cases, a variant CD86 polypeptide has 9 amino acid substitutions compared to the CD86 amino acid sequence set forth in SEQ ID NO:9. In some cases, a variant CD86 polypeptide has 10 amino acid substitutions compared to the CD86 amino acid sequence set forth in SEQ ID NO:9.

Suitable CD86 variants include a polypeptide that comprises an amino acid sequence having at least 90%, at least 95%, at least 98%, at least 99%, or 100%, amino acid sequence identity to any one of the following amino acid sequences:
APLKIQAYFNETADLPCQFANSQNQSLSELVVFWQDQENLVLNEVYLGKEKFDSVHSKY MXRTSFDSDSWTLRLHNLQIKDKGLYQCIIHHKKPTGMTRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:96), where X is any amino acid other than Asn. In some cases, X is Ala;
APLKIQAYFNETADLPCQFANSQNQSLSELVVFWQDQENLVLNEVYLGKEKFDSVHSKY MNRTSF X̲SDSWTLRLHNLQIKDKGLYQCIIHHKKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:97), where X is any amino acid other than Asp. In some cases, X is Ala;
APLKIQAYFNETADLPCQFANSQNQSLSELVVFWQDQENLVLNEVYLGKEKFDSVHSKY MNRTSFDSDSX̲TLRLHNLQIKDKGLYQCIIHHKKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:98), where X is any amino acid other than Trp. In some cases, X is Ala;
APLKIQAYFNETADLPCQFANSQNQSLSELVVFWQDQENLVLNEVYLGKEKFDSVHSKY MNRTSFDSDSWTLRLHNLQIKDKGLYQCIIHX̲KKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:99), where X is any amino acid other than His. In some cases, X is Ala;

```
                                    (SEQ ID NO: 100)
APLKIQAYFNETADLPCQFANSQNQSLSELVVFWQDQENLVLNEVYLGKE

KFDSVHSKYMX̲RTSFDSDSWTLRLHNLQIKDKGLYQCIIHHKKPTGMIRI

HQMNSELSVL,
``` where X is any amino acid other than Asn. In some cases, X is Ala;

```
                                    (SEQ ID NO: 101)
APLKIQAYFNETADLPCQFANSQNQSLSELVVFWQDQENLVLNEVYLCKE

KFDSVHSKYMNRTSFX̲SDSWTLRLHNLQIKDKGLYQCIIHHKKPTGMIRI

HQMNSELSVL,
``` where X is any amino acid other than Asp. In some cases, X is Ala;

```
                                    (SEQ ID NO: 102)
APLKIQAYFNETADLPCQFANSQNQSLSELVVFWQDQENLVLNEVYLGKE

KFDSVHSKYMNRTSFDSDSX̲TLRLHNLQIKDKGLYQCIIHHKKPTGMIRI

HQMNSELSVL,
``` where X is any amino acid other than Trp. In some cases, X is Ala;

```
                                    (SEQ ID NO: 103)
APLKIQAYFNETADLPCQFANSQNQSLSELVVFWQDQENLVLNEVYLGKE

KFDSVHSKYMNRTSFDSDSWTLRLHNLQIKDKGLYQCIIHX̲KKPTGMIRI

HQMNSELSVL,
``` where X is any amino acid other than His. In some cases, X is Ala;
APLKIQAYFNETADLPCQFANSQNQSLSELVVFWQDQENLXLNEVYLGKEKFDSVHSKY MNRTSFDSDSWTLRLHNLQIKDKGLYQCIIHHKKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:104), where X is any amino acid other than Val. In some cases, X is Ala;

```
                                    (SEQ ID NO: 105)
APLKIQAYFNETADLPCQFANSQNQSLSELVVFWQDQENLX̲LNEVYLGKE

KFDSVHSKYMNRTSFDSDSWTLRLHNLQIKDKGLYQCIIHHKKPTGMIRI

HQMNSELSVL,
``` where X is any amino acid other than Val. In some cases, X is Ala;
APLKIQAYFNETADLPCQFANSQNQSLSELVVFW X̲DQENLVLNEVYLGKEKFDSVHSKY MNRTSFDSDSWTLRLHNLQIKDKGLYQCIIHHKKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:106), where X is any amino acid other than Gln. In some cases, X is Ala;

```
                                    (SEQ ID NO: 107)
APLKIQAYFNETADLPCQFANSQNQSLSELVVFWX̲DQENLVLNEVYLGKE

KFDSVHSKYMNRTSFDSDSWTLRLHNLQIKDKGLYQCIIHHKKPTGMIRI

HQMNSELSVL,
``` where X is any amino acid other than Gln. In some cases, X is Ala;
APLKIQAYFNETADLPCQFANSQNQSLSELVV X̲WQD-QENLVLNEVYLGKEKFDSVHSKY MNRTSFDSDSWTLRLHNLQIKDKGLYQCIIHHKKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:108), where X is any amino acid other than Phe. In some cases, X is Ala;

APLKIQAYFNETADLPCQFANSQNQSLSELVV$\underline{X}$WQDQENLVLNEVYLGKE (SEQ ID NO: 109)

KFDSVHSKYMNRTSFDSDSWTLRLHNLQIKDKGLYQCIIHHKKPTGMIRI

HQMNSELSVL, where X is any amino acid other than Phe. In some cases, X is Ala;

APLKIQAYFNETADLPCQFANSQNQSLSELVVFWQDQENLVLNEVYLGKEKFDSVHSKY MNRTSFDSDSWT$\underline{X}$RLHNLQIKDKCLYQCIIHHKKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:110), where X is any amino acid other than Leu. In some cases, X is Ala;

APLKIQAYFNETADLPCQFANSQNQSLSELVVFWQDQENLVLNEVYLGKE (SEQ ID NO: 111)

KFDSVHSKYMNRTSFDSDSWT$\underline{X}$RLHNLQIKDKGLYQCIIHHKKPTGMIRI

HQMNSELSVL, where X is any amino acid other than Leu. In some cases, X is Ala;

APLKIQAYFNETADLPCQFANSQNQSLSELVVFWQDQENLVLNEVYLGKEKFDSVHSK$\underline{X}$MNRTSFDSDSWTLRLHNLQIKDKGLYQCIIHHKKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:112), where X is any amino acid other than Tyr. In some cases, X is Ala;

APLKIQAYFNETADLPCQFANSQNQSLSELVVFWQDQENLVLNEVYLGKE (SEQ ID NO: 113)

KFDSVHSK$\underline{X}$MNRTSFDSDSWTLRLHNLQIKDKGLYQCIIHHKKPTGMIRI

HQMNSELSVL, where X is any amino acid other than Tyr. In some cases, X is Ala;

APLKIQAYFNETADLPCQFANSQNQSLSELVVFWQDQENLVLNEVYLGKEKFDSVHSKY M$\underline{X}$RTSFDSDSWTLRLHNLQIKDKGLYQCIIH$\underline{X}$KKPTGMIRIHQMNSELSVLANFSQPEIVPISN ITENVYINLTCSSIHGYPEPKKMSVLLRTKNSTIEYDGIMQKSQDNVTELYDVSISLSVSFPDV TSNMTIFCILETDKTRLLSSPFSIELEDPQPPPDHIP (SEQ ID NO:114), where the first X is any amino acid other than Asn and the second X is any amino acid other than His. In some cases, the first and the second X are both Ala;

APLKIQAYFNETADLPCQFANSQNQSLSELVVFWQDQENLVLNEVYLGKE (SEQ ID NO: 115)

KFDSVHSKYM$\underline{X}$RTSFDSDSWTLRLHNLQIKDKGLYQCIIH$\underline{X}$KKPTGMIRI

HQMNSELSVL, where the first X is any amino acid other than Asn and the second X is any amino acid other than His. In some cases, the first and the second X are both Ala;

APLKIQAYFNETADLPCQFANSQNQSLSELVVFWQDQENLVLNEVYLGKEKFDSVHSKY MNRTSF$\underline{X_1}$SDSWTLRLHNLQIKDKGLYQCIIH$\underline{X_2}$KKPTGMIRIHQMNSELSVLANFSQPEIVPIS NITENVYINLTCSSIHGYPEPKKMSVLLRTKNSTIEYDGIMQKSQDNVTELYDVSISLSVSFPD VTSNMTIFCILETDKTRLLSSPFSIELEDPQPPPDHIP (SEQ ID NO:116), where $X_1$ is any amino acid other than Asp, and $X_2$ is any amino acid other than His. In some cases, $X_1$ is Ala and $X_2$ is Ala;

APLKIQAYFNETADLPCQFANSQNQSLSELVVFWQDQENLVLNEVYLGKEKFDSVHSKY MNRTSF $\underline{X_1}$ SDSWTLRLHNLQIKDKGLYQCIIH$\underline{X_2}$ KKPTGMIRIHQMNSELSVL (SEQ ID NO:117), where the first X is any amino acid other than Asn and the second X is any amino acid other than His. In some cases, the first and the second X are both Ala;

APLKIQAYFNETADLPCQFANSQNQSLSELVVFW QDQENLVLNEVYLGKEKFDSVHSKY M$\underline{X_1}$ RTSF$\underline{X_2}$ SDSWTLRLHNLQIKDKGLYQCIIH $\underline{X_3}$ KKPTGMIRIHQMNSELSVLANFSQPEIVPI SNITENVYINLICSSIHGYPEPKKMSVLLRTKNSTIEYDGIMQKSQDNVTELYDVSISLSVSFP DVTSNMTIFCILETDKTRLLSSPFSIELEDPQPPPDHIP (SEQ ID NO:118), where $X_1$ is any amino acid other than Asn, $X_2$ is any amino acid other than Asp, and $X_3$ is any amino acid other than His. In some cases, $X_1$ is Ala, $X_2$ is Ala, and $X_3$ is Ala; and APLKIQAYFNETADLPCQFANSQNQSLSELVVFWQDQENLVLNEVYLGKEKFDSVHSKY M$\underline{X_1}$ RTSF $\underline{X_2}$ SDSWTLRLHNLQIKDKGLYQCIIH $\underline{X_3}$ KKPTGMIRIHQMNSELSVL (SEQ ID NO:119), where $X_1$ is any amino acid other than Asn, $X_2$ is any amino acid other than Asp, and $X_3$ is any amino acid other than His. In some cases, $X_1$ is Ala, $X_2$ is Ala, and $X_3$ is Ala.

4-1BBL Variants

In some cases, a variant immunomodulatory polypeptide present in a T-cell modulatory multimeric polypeptide of the present disclosure is a variant 4-1BBL polypeptide. Wild-type 4-1BBL binds to 4-1BB (CD137).

A wild-type 4-1BBL amino acid sequence can be as follows:

(SEQ ID NO: 10)
MEYASDASLD PEAPWPPAPR ARACRVLP$\underline{WA}$ $\underline{LVAGLLLLLL}$ $\underline{LAAACAVFLA}$ CPWAVSGARA SPGSAASPRL REGPELSPDD

PAGLLDLRQG MFAQLVAQNV LLIDGPLSWY SDPGLAGVSL

TGGLSYKEDT KELVVAKAGV YVFFQLELR RVVAGEGSGS

VSLALHLQPL RSAAGAAALA LTVDLPPASS EARNSAFGFQ

GRLLHLSAGQ RLGVHLHTEA RARHAWQLTQ GATVLGLFRV

TPEIPAGLPS PRSE.

In some cases, a variant 4-1BBL polypeptide is a variant of the tumor necrosis factor (TNF) homology domain (THD) of human 4-1BBL.

A wild-type amino acid sequence of the THD of human 4-1BBL can be, e.g., one of SEQ TD NOs:11-13, as follows:

(SEQ ID NO: 11)
PAGLLDLRQG MFAQLVAQNV LLIDGPLSWY SDPGLAGVSL

TGGLSYKEDT KELVVAKAGV YVFFQLELR RVVAGEGSGS

VSLALHLQPL RSAAGAAALA LTVDLPPASS EARNSAFGFQ

-continued

GRLLHLSAGQ RLGVHLHTEA RARHAWQLTQ GATVLGLFRV

TPEIPAGLPS PRSE.

(SEQ ID NO: 12)
D PAGLLDLRQG MFAQLVAQNV LLIDGPLSWY SDPGLAGVSL

TGGLSYKEDT KELVVAKAGV YYVFFQLELR RVVAGEGSGS

VSLALHLQPL RSAAGAAALA LTVDLPPASS EARNSAFGFQ

GRLLHLSAGQ RLGVHLHTEA RARHAWQLTQ GATVLGLFRV

TPEIPAGLPS PRSE.

(SEQ ID NO: 13)
D PAGLLDLRQG MFAQLVAQNV LLIDGPLSWY SDPGLAGVSL

TGGLSYKEDT KELVVAKAGV YYVFFQLELR RVVAGEGSGS

VSLALHLQPL RSAAGAAALA LTVDLPPASS EARNSAFGFQ

GRLLHLSAGQ RLGVHLHTEA RARHAWQLTQ GATVLGLFRV

TPEIPA.

A wild-type 4-1BB amino acid sequence can be as follows: MGNSCYNIVA TLLLVLNFER TRSLQDPCSN CPAGTFCDNN RNQICSPCPP NSFSSAGGQR TCDICRQCKG VFRTRKECSS TSNAECDCTP GFHCLGAGCS MCEQDCKQGQ ELTKKGCKDC CFGTFNDQKR GICRPWTNCS LDGKSVLVNG TKERDVVCGP SPADLSPGAS SVTPPAPARE PGHSPQIISF FLALTSTALL FLLFFLTLRF SVVKRGRKKL LYIFKQPFMR PVQTTQEEDG CSCRFPEEEE GGCEL (SEQ ID NO:14). In some cases, where a T-cell modulatory multimeric polypeptide of the present disclosure comprises a variant 4-1BBL polypeptide, a "cognate co-immunomodulatory polypeptide" is a 4-1BB polypeptide comprising the amino acid sequence of SEQ ID NO:14.

In some cases, a variant 4-1BBL polypeptide exhibits reduced binding affinity to 4-1BB, compared to the binding affinity of a 4-1BBL polypeptide comprising the amino acid sequence set forth in one of SEQ ID NOs:10-13. For example, in some cases, a variant 4-1BBL polypeptide of the present disclosure binds 4-1BB with a binding affinity that is at least 10% less, at least 15% less, at least 20% less, at least 25%, at least 30% less, at least 35% less, at least 40% less, at least 45% less, at least 50% less, at least 55% less, at least 60% less, at least 65% less, at least 70% less, at least 75% less, at least 80% less, at least 85% less, at least 90% less, at least 95% less, or more than 95% less, than the binding affinity of a 4-1BBL polypeptide comprising the amino acid sequence set forth in one of SEQ ID NOs:10-13 for a 4-1BB polypeptide (e.g., a 4-1BB polypeptide comprising the amino acid sequence set forth in SEQ ID NO:14), when assayed under the same conditions.

In some cases, a variant 4-1BBL polypeptide has a binding affinity to 4-1BB that is from 100 nM to 100 µM. As another example, in some cases, a variant 4-1BBL polypeptide has a binding affinity for 4-1BB (e.g., a 4-1BB polypeptide comprising the amino acid sequence set forth in SEQ ID NO:14) that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 µM, to about 1 µM to about 5 µM, from about 5 µM to about 10 µM, from about 10 µM to about 15 µM, from about 15 µM to about 20 µM, from about 20 µM to about 25 µM, from about 25 µM to about 50 µM, from about 50 µM to about 75 µM, or from about 75 µM to about 100 µM.

In some cases, a variant 4-1BBL polypeptide has a single amino acid substitution compared to the 4-1BBL amino acid sequence set forth in one of SEQ ID NOs:10-13. In some cases, a variant 4-1BBL polypeptide has from 2 to 10 amino acid substitutions compared to the 4-1BBL amino acid sequence set forth in one of SEQ ID NOs:10-13. in some cases, a variant 4-1BBL polypeptide has 2 amino acid substitutions compared to the 4-1BBL amino acid sequence set forth in one of SEQ ID NOs:10-13. In some cases, a variant 4-1BBL polypeptide has 3 amino acid substitutions compared to the 4-1BBL amino acid sequence set forth in one of SEQ ID NOs:10-13. In some cases, a variant 4-1BBL polypeptide has 4 amino acid substitutions compared to the 4-1BBL amino acid sequence set forth in one of SEQ ID NOs:10-13. In some cases, a variant 4-1BBL polypeptide has 5 amino acid substitutions compared to the 4-1BBL amino acid sequence set forth in one of SEQ ID NOs:10-13. In some cases, a variant 4-1BBL polypeptide has 6 amino acid substitutions compared to the 4-1BBL amino acid sequence set forth in one of SEQ ID NOs:10-13. In some cases, a variant 4-1BBL polypeptide has 7 amino acid substitutions compared to the 4-1BBL amino acid sequence set forth in one of SEQ ID NOs:10-13. In some cases, a variant 4-1BBL polypeptide has 8 amino acid substitutions compared to the 4-1BBL amino acid sequence set forth in one of SEQ ID NOs:10-13. In some cases, a variant 4-1BBL polypeptide has 9 amino acid substitutions compared to the 4-1BBL amino acid sequence set forth in one of SEQ ID NOs:10-13. In some cases, a variant 4-1BBL polypeptide has 10 amino acid substitutions compared to the 4-1BBL amino acid sequence set forth in one of SEQ ID NOs:10-13.

Suitable 4-1BBL variants include a polypeptide that comprises an amino acid sequence having at least 90%, at least 95%, at least 98%, at least 99%, or 100%, amino acid sequence identity to any one of the following amino acid sequences:

PAGLLDLRQG MFAQLVAQNV LLIDGPLSWY SDPGLAGVSL TGGLSY<u>X</u>EDT KELVVAKAGV YYVFFQLELR RVVAGEGSGS VSLALHLQPL RSAAGAAALA LTVDLPPASS EARNS AFGFQ GRLLHLSAGQ RLGVHLHTEA RARHAWQLTQ GATVLGLFRV TPEIPAGLPS PRSE (SEQ ID NO:120), where X is any amino acid other than Lys. In some cases, X is Ala;

PAGLLDLRQG MFAQLVAQNV LLIDGPLSWY SDPGLAGVSL TGGLSYKEDT KELVVAKAGV YYVFFQLELR RVVAGEGSGS VSLALHLQPL RSA AGA A ALA LTVDLPPASS EARNSAFGFQ GRLLHLSAGQ RLGVHLHTEA RARHAW<u>X</u>LTQ GATVLGLFRV TPEIPAGLPS PRSE (SEQ ID NO:121), where X is any amino acid other than Gln. In some cases, X is Ala;

PAGLLDLRQG <u>X</u>FAQLVAQNV LLIDGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:122), where X is any amino acid other than Met. In some cases, X is Ala;

PAGLLDLRQG M<u>X</u>AQLVAQNV LLIDGPLSWY SDPGLAGVSL TGGLSYKEDT KELVVAKAGV YYVFFQLELR RVVAGEGSGS VSLALHLQPL

RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:123),
where X is any amino acid other than Phe. In some cases, X is Ala;

PAGLLDLRQG MFA<u>X</u>LVAQNV LLIDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:124),
where X is any amino acid other than Gln. In some cases, X is Ala;

PAGLLDLRQG MFAQ<u>X</u>VAQNV LLIDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:125),
where X is any amino acid other than Leu. In some cases, X is Ala;

PAGLLDLRQG MFAQL<u>X</u>AQNV LLIDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:126),
where X is any amino acid other than Val. In some cases, X is Ala;

PAGLLDLRQG MFAQLVA<u>X</u>NV LLIDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:127),
where X is any amino acid other than Gln. In some cases, X is Ala;

PAGLLDLRQG MFAQLVAQ<u>X</u>V LLIDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:128),
where X is any amino acid other than Asn. In some cases, X is Ala;

PAGLLDLRQG MFAQLVAQN<u>X</u> LLIDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:129),
where X is any amino acid other than Val. In some cases, X is Ala;

PAGLLDLRQG MFAQLVAQNV <u>X</u>LIDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:130),
where X is any amino acid other than Leu. In some cases, X is Ala;

PAGLLDLRQG MFAQLVAQNV L<u>X</u>IDGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:131),
where X is any amino acid other than Leu. In some cases, X is Ala;

PAGLLDLRQG MFAQLVAQNV LL<u>X</u>DGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:132),
where X is any amino acid other than Ile. In some cases, X is Ala;

PAGLLDLRQG MFAQLVAQNV LLI<u>X</u>GPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:133),
where X is any amino acid other than Asp. In some cases, X is Ala;

PAGLLDLRQG MFAQLVAQNV LLID<u>X</u>PLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:134),
where X is any amino acid other than Gly. In some cases, X is Ala;

PAGLLDLRQG MFAQLVAQNV LLIGG<u>X</u>LSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:135),
where X is any amino acid other than Pro. In some cases, X is Ala;

PAGLLDLRQG MFAQLVAQNV LLIGGP<u>X</u>SWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:136),
where X is any amino acid other than Leu. In some cases, X is Ala;

PAGLLDLRQG MFAQLVAQNV LLIGGPL<u>X</u>WY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:137),
where X is any amino acid other than Ser. In some cases, X is Ala;

PAGLLDLRQG MFAQLVAQNV LLIGGPLS<u>X</u>Y
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:138),
where X is any amino acid other than Trp. In some cases, X is Ala;

PAGLLDLRQG MFAQLVAQNV LLIGGPLSW<u>X</u>
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:139),
where X is any amino acid other than Tyr. In some cases, X is Ala;

PAGLLDLRQG MFAQLVAQNV LLIGGPLSWY XDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:140), where X is any amino acid other than Ser. In some cases, X is Ala;

PAGLLDLRQG MFAQLVAQNV LLIGGPLSWY S XPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:141), where X is any amino acid other than Asp. In some cases, X is Ala;

PAGLLDLRQG MFAQLVAQNV LLIGGPLSWY SD XGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:142), where X is any amino acid other than Pro. In some cases, X is Ala;

PAGLLDLRQG MFAQLVAQNV LLIGGPLSWY SDP XAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:143), where X is any amino acid other than Gly. In some cases, X is Ala;

PAGLLDLRQG MFAQLVAQNV LLIGGPLSWY SDPG XAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:144), where X is any amino acid other than Leu. In some cases, X is Ala;

PAGLLDLRQG MFAQLVAQNV LLIGGPLSWY SDPGLAXVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:145), where X is any amino acid other than Gly. In some cases, X is Ala;

PAGLLDLRQG MFAQLVAQNV LLIGGPLSWY SDPGLAGXSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:146), where X is any amino acid other than Val. In some cases, X is Ala;

PAGLLDLRQG MFAQLVAQNV LLIGGPLSWY SDPGLAGVXL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:147), where X is any amino acid other than Ser. In some cases, X is Ala;

PAGLLDLRQG MFAQLVAQNV LLIGGPLSWY SDPGLAGVSX TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:148), where X is any amino acid other than Leu. In some cases, X is Ala;

PAGLLDLRQG MFAQLVAQNV LLIGGPLSWY SDPGLAGVSL XGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:149), where X is any amino acid other than Thr. In some cases, X is Ala;

PAGLLDLRQG MFAQLVAQNV LLIGGPLSWY SDPGLAGVSL TXGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:150), where X is any amino acid other than Gly. In some cases, X is Ala;

PAGLLDLRQG MFAQLVAQNV LLIGGPLSWY SDPGLAGVSL TGXLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:151), where X is any amino acid other than Gly. In some cases, X is Ala;

PAGLLDLRQG MFAQLVAQNV LLIGGPLSWY SDPGLAGVSL TGGXSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:152), where X is any amino acid other than Leu. In some cases, X is Ala;

PAGLLDLRQG MFAQLVAQNV LLIGGPLSWY SDPGLAGVSL TGGLXYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:153), where X is any amino acid other than Ser. In some cases, X is Ala;

PAGLLDLRQG MFAQLVAQNV LLIGGPLSWY SDPGLAGVSL TGGLSXKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:154), where X is any amino acid other than Tyr. In some cases, X is Ala;

PAGLLDLRQG MFAQLVAQNV LLIGGPLSWY SDPGLAGVSL TGGLSYKXDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:155), where X is any amino acid other than Glu. In some cases, X is Ala;

PAGLLDLRQG MFAQLVAQNV LLIGGPLSWY SDPGLAGVSL TGGLSYKEXT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ

GATVLGLFRV TPEIPAGLPS PRSE (SEQ ID NO:156), where X is any amino acid other than Asp. In some cases, X is Ala;

PAGLLDLRQG MFAQLVAQNV LLIGGPLSWY SDPGLAGVSL TGGLSYKED<u>X</u>KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:157), where X is any amino acid other than Thr. In some cases, X is Ala;

PAGLLDLRQG MFAQLVAQNV LLIGGPLSWY SDPGLAGVSL TGGLSYKEDT <u>X</u>ELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:158), where X is any amino acid other than Lys. In some cases, X is Ala;

PAGLLDLRQG MFAQLVAQNV LLIGGPLSWY SDPGLAGVSL TGGLSYKEDT K<u>X</u>LVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:159), where X is any amino acid other than Glu. In some cases, X is Ala;

PAGLLDLRQG MFAQLVAQNV LLIGGPLSWY SDPGLAGVSL TGGLSYKEDT KELVVAKAGV YYV <u>X</u>FQLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:160), where X is any amino acid other than Phe. In some cases, X is Ala;

PAGLLDLRQG MFAQLVAQNV LLIGGPLSWY SDPGLAGVSL TGGLSYKEDT KELVVAKAGV YYVF <u>X</u>QLELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:161), where X is any amino acid other than Phe. In some cases, X is Ala;

PAGLLDLRQG MFAQLVAQNV LLIGGPLSWY SDPGLAGVSL TGGLSYKEDT KELVVAKAGV YYVFF <u>X</u>LELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:162), where X is any amino acid other than Gln. In some cases, X is Ala;

PAGLLDLRQG MFAQLVAQNV LLIGGPLSWY SDPGLAGVSL TGGLSYKEDT KELVVAKAGV YYVFFQ<u>X</u>ELR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:163), where X is any amino acid other than Leu. In some cases, X is Ala;

PAGLLDLRQG MFAQLVAQNV LLIGGPLSWY SDPGLAGVSL TGGLSYKEDT KELVVAKAGV YYVFFQL<u>X</u>LR RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:164), where X is any amino acid other than Glu. In some cases, X is Ala;

PAGLLDLRQG MFAQLVAQNV LLIGGPLSWY SDPGLAGVSL TGGLSYKEDT KELVVAKAGV YYVFFQLE<u>X</u>R RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:165), where X is any amino acid other than Leu. In some cases, X is Ala;

PAGLLDLRQG MFAQLVAQNV LLIGGPLSWY SDPGLAGVSL TGGLSYKEDT KELVVAKAGV YYVFFQLEL<u>X</u>RVVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:166), where X is any amino acid other than Arg. In some cases, X is Ala;

PAGLLDLRQG MFAQLVAQNV LLIGGPLSWY SDPGLAGVSL TGGLSYKEDT KELVVAKAGV YYVFFQLELR <u>X</u>VVAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:167), where X is any amino acid other than Arg. In some cases, X is Ala;

PAGLLDLRQG MFAQLVAQNV LLIGGPLSWY SDPGLAGVSL TGGLSYKEDT KELVVAKAGV YYVFFQLELR R<u>X</u>VAGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:168), where X is any amino acid other than Val. In some cases, X is Ala;

PAGLLDLRQG MFAQLVAQNV LLIGGPLSWY SDPGLAGVSL TGGLSYKEDT KELVVAKAGV YYVFFQLELR RV<u>X</u>AGEGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:169), where X is any amino acid other than Val. In some cases, X is Ala;

PAGLLDLRQG MFAQLVAQNV LLIGGPLSWY SDPGLAGVSL TGGLSYKEDT KELVVAKAGV YYVFFQLELR RVVA<u>X</u>EGSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:170), where X is any amino acid other than Gly. In some cases, X is Ala;

PAGLLDLRQG MFAQLVAQNV LLIGGPLSWY SDPGLAGVSL TGGLSYKEDT KELVVAKAGV YYVFFQLELR RVVAG<u>X</u>GSGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:171), where X is any amino acid other than Glu. In some cases, X is Ala;

PAGLLDLRQG MFAQLVAQNV LLIGGPLSWY SDPGLAGVSL TGGLSYKEDT KELVVAKAGV YYVFFQLELR RVVAGE<u>X</u>SGS VSLALHLQPL RSAAGAAALA LTVDLPPASS EARNSAFGFQ GRLLHLSAGQ RLGVHLHTEA RARHAWQLTQ GATVLGLFRV TPEIPAGLPS PRSE (SEQ ID NO:172), where X is any amino acid other than Gly. In some cases, X is Ala;

PAGLLDLRQG MFAQLVAQNV LLIGGPLSWY SDPGLAGVSL TGGLSYKEDT KELVVAKAGV YYVFFQLELR RVVAGEG<u>X</u>GS VSLALHLQPL

RSAAGAAALA LTVDLPPASS EARNSAFGFQ
GRLLHLSAGQ RLGVHLHTEA RARHAWQLTQ
GATVLGLFRV TPEIPAGLPS PRSE (SEQ ID NO:173),
where X is any amino acid other than Ser. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTV<u>X</u>LPPASS EARNSAFGFQ
GRLLHLSAGQ RLGVHLHTEA RARHAWQLTQ
GATVLGLFRV TPEIPAGLPS PRSE (SEQ ID NO:174),
where X is any amino acid other than Asp. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVD<u>X</u>PPASS EARNSAFGFQ
GRLLHLSAGQ RLGVHLHTEA RARHAWQLTQ
GATVLGLFRV TPEIPAGLPS PRSE (SEQ ID NO:175),
where X is any amino acid other than Leu. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDL<u>X</u>PASS EARNSAFGFQ
GRLLHLSAGQ RLGVHLHTEA RARHAWQLTQ
GATVLGLFRV TPEIPAGLPS PRSE (SEQ ID NO:176),
where X is any amino acid other than Pro. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPA<u>X</u>S EARNSAFGFQ
GRLLHLSAGQ RLGVHLHTEA RARHAWQLTQ
GATVLGLFRV TPEIPAGLPS PRSE (SEQ ID NO:177),
where X is any amino acid other than Ser. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPAS<u>X</u> EARNSAFGFQ
GRLLHLSAGQ RLGVHLHTEA RARHAWQLTQ
GATVLGLFRV TPEIPAGLPS PRSE (SEQ ID NO:178),
where X is any amino acid other than Ser. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS <u>X</u>ARNSAFGFQ
GRLLHLSAGQ RLGVHLHTEA RARHAWQLTQ
GATVLGLFRV TPEIPAGLPS PRSE (SEQ ID NO:179),
where X is any amino acid other than Glu. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EA<u>X</u>NSAFGFQ
GRLLHLSAGQ RLGVHLHTEA RARHAWQLTQ
GATVLGLFRV TPEIPAGLPS PRSE (SEQ ID NO:180),
where X is any amino acid other than Arg. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EAR<u>X</u>SAFGFQ
GRLLHLSAGQ RLGVHLHTEA RARHAWQLTQ
GATVLGLFRV TPEIPAGLPS PRSE (SEQ ID NO:181),
where X is any amino acid other than Asn. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARN<u>X</u>AFGFQ
GRLLHLSAGQ RLGVHLHTEA RARHAWQLTQ
GATVLGLFRV TPEIPAGLPS PRSE (SEQ ID NO:182),
where X is any amino acid other than Ser. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARNSA<u>X</u>GFQ
GRLLHLSAGQ RLGVHLHTEA RARHAWQLTQ
GATVLGLFRV TPEIPAGLPS PRSE (SEQ ID NO:183),
where X is any amino acid other than Phe. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAG<u>X</u> RLGVHLHTEA RARHAWQLTQ
GATVLGLFRV TPEIPAGLPS PRSE (SEQ ID NO:184),
where X is any amino acid other than Gln. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ <u>X</u>LGVHLHTEA RARHAWQLTQ
GATVLGLFRV TPEIPAGLPS PRSE (SEQ ID NO:185),
where X is any amino acid other than Arg. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ R<u>X</u>GVHLHTEA RARHAWQLTQ
GATVLGLFRV TPEIPAGLPS PRSE (SEQ ID NO:186),
where X is any amino acid other than Leu. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RL<u>X</u>VHLHTEA RARHAWQLTQ
GATVLGLFRV TPEIPAGLPS PRSE (SEQ ID NO:187),
where X is any amino acid other than Gly. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLG<u>X</u>HLHTEA RARHAWQLTQ
GATVLGLFRV TPEIPAGLPS PRSE (SEQ ID NO:188),
where X is any amino acid other than Val. In some cases, X
is Ala;

PAGLLDLRQG MFAQLVAQNV LLIGGPLSWY
SDPGLAGVSL TGGLSYKEDT KELVVAKAGV
YYVFFQLELR RVVAGEGSGS VSLALHLQPL
RSAAGAAALA LTVDLPPASS EARNSAFGFQ
GRLLHLSAGQ RLGV<u>X</u>LHTEA RARHAWQLTQ
GATVLGLFRV TPEIPAGLPS PRSE (SEQ ID NO:189),
where X is any amino acid other than His. In some cases, X
is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVH<u>X</u>HTEA RARHAWQLTQ GATVLGLFRV TPEIPAGLPS PRSE (SEQ ID NO:190), where X is any amino acid other than Leu. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHL<u>X</u>TEA RARHAWQLTQ GATVLGLFRV TPEIPAGLPS PRSE (SEQ ID NO:191), where X is any amino acid other than His. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLH<u>X</u>EA RARHAWQLTQ GATVLGLFRV TPEIPAGLPS PRSE (SEQ ID NO:192), where X is any amino acid other than Thr. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHT<u>X</u>A RARHAWQLTQ GATVLGLFRV TPEIPAGLPS PRSE (SEQ ID NO:193), where X is any amino acid other than Glu. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA <u>X</u>ARHAWQLTQ GATVLGLFRV TPEIPAGLPS PRSE (SEQ ID NO:194), where X is any amino acid other than Arg. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RA<u>X</u>HAWQLTQ GATVLGLFRV TPEIPAGLPS PRSE (SEQ ID NO:195), where X is any amino acid other than Arg. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RAR<u>X</u>AWQLTQ GATVLGLFRV TPEIPAGLPS PRSE (SEQ ID NO:196), where X is any amino acid other than His. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHA<u>X</u>QLTQ GATVLGLFRV TPEIPAGLPS PRSE (SEQ ID NO:197), where X is any amino acid other than Trp. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQ<u>X</u>TQ GATVLGLFRV TPEIPAGLPS PRSE (SEQ ID NO:198), where X is any amino acid other than Leu. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQL<u>X</u>Q GATVLGLFRV TPEIPAGLPS PRSE (SEQ ID NO:199), where X is any amino acid other than Thr. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARN SAFGFQ GRLLHLSAGQ RLGVHLHTEA RARHAWQLT<u>X</u> GATVLGLFRV TPEIPAGLPS PRSE (SEQ ID NO:200), where X is any amino acid other than Gln. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ <u>X</u>ATVLGLFRV TPEIPAGLPS PRSE (SEQ ID NO:201), where X is any amino acid other than Gly. In some cases, X is Ala;

PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GA<u>X</u>VLGLFRV TPEIPAGLPS PRSE (SEQ ID NO:202), where X is any amino acid other than Thr. In some cases, X is Ala; and PAGLLDLRQG MFAQLVAQNV LLIGGPLSWY SDPGLAGVSL TGGLSYKEDT KELVVAKAGV YYVFFQLELR RVVAGEGSGS VSLALHLQPL RSAAGAAALA LTVDLPPASS EARNSAFGFQ GRLLHLSAGQ RLGVHLHTEA RARHAWQLTQ GAT<u>X</u>LGLFRV TPEIPAGLPS PRSE (SEQ ID NO:203), where X is any amino acid other than Val. In some cases, X is Ala.

IL-2 Variants

In some cases, a variant immunomodulatory polypeptide present in a T-cell modulatory multimeric polypeptide of the present disclosure is a variant IL-2 polypeptide. Wild-type IL-2 binds to IL-2 receptor (IL-2R), i.e., a heterotrimeric polypeptide comprising IL-2Rα, IL-2Rβ, and IL-2Rγ.

A wild-type IL-2 amino acid sequence can be as follows: APTSSSTKKT QLQL<u>EHLLLD</u> LQMILNGINN YKNPKLTRML T<u>F</u>KF<u>Y</u>MPKKA TELKHLQCLEEELKPLEEVL NLAQSKNFHL RPRDLISNIN VIVLELKGSE TTFMCEYADE TATIVE-FLNRWITFCQSIIS TLT (SEQ ID NO:15).

Wild-type IL2 binds to an IL2 receptor (IL2R) on the surface of a cell. An IL2 receptor is in some cases a heterotrimeric polypeptide comprising an alpha chain (IL-2Rα; also referred to as CD25), a beta chain (IL-2Rβ; also referred to as CD122; and a gamma chain (IL-2Rγ; also referred to as CD132) Amino acid sequences of human IL-2Rα, IL2Rγ, and IL-2Rγ can be as follows.

Human IL-2Rα:

(SEQ ID NO: 16)
ELCDDDPPE IPHATFKAMA YKEGTMLNCE CKRGFRRIKS

GSLYMLCTGN SSHSSWDNQC QCTSSATRNT TKQVTPQPEE

QKERKTTEMQ SPMQPVDQAS LPGHCREPPP WENEATERIY

HFVVGQMVYY QCVQGYRALH RGPAESVCKM THGKTRWTQP

QLICTGEMET SQFPGEEKPQ ASPEGRPESE TSCLVTTTDF

QIQTEMAATM ETSIFTTEYQ VAVAGCVFLL ISVLLLSGLT

WQRRQRKSRR TI.

Human IL-2Rβ:

(SEQ ID NO: 17)
VNG TSQFTCFYNS RANISCVWSQ DGALQDTSCQ

VHAWPDRRRW NQTCELLPVS QASWACNLIL GAPDSQKLTT

VDIVTLRVLC REGVRWRVMA IQDFKPFENL RLMAPISLQV

VHVETHRCNI SWEISQASHY FERHLEFEAR TLSPGHTWEE

APLLTLKQKQ EWICLETLTP DTQYEFQVRV KPLQGEFTTW

SPWSQPLAFR TKPAALGKDT IPWLGHLLVG LSGAFGFIIL

VYLLINCRNT GPWLKKVLKC NTPDPSKFFS QLSSEHGGDV

QKWLSSPFPS SSFSPGGLAP EISPLEVLER DKVTQLLLQQ

DKVPEPASLS SNHSLTSCFT NQGYFFFHLP DALEIEACQV

YFTYDPYSEE DPDEGVAGAP TGSSPQPLQP LSGEDDAYCT

FPSRDDLLLF SPSLLGGPSP PSTAPGGSGA GEERMPPSLQ

ERVPRDWDPQ PLGPPTPGVP DLVDFQPPPE LVLREAGEEV

PDAGPREGVS FPWSRPPGQG EFRALNARLP LNTDAYLSLQ

ELQGQDPTHL V.

Human IL-2Rγ:

(SEQ ID NO: 18)
LNTTILTP NGNEDTTADF FLTTMPTDSL SVSTLPLPEV

QCFVFNVEYM NCTWNSSSEP QPTNLTLHYW YKNSDNDKVQ

KCSHYLFSEE ITSGCQLQKK EIHLYQTFVV QLQDPREPRR

QATQMLKLQN LVIPWAPENL TLHKLSESQL ELNWNNRFLN

HCLEHLVQYR TDWDHSWTEQ SVDYRHKFSL PSVDGQKRYT

FRVRSRFNPL CGSAQHWSEW SHPIHWGSNT SKENPFLFAL

EAVVISVGSM GLIISLLCVY FWLERTMPRI PTLKNLEDLV

TEYHGNFSAW SGVSKGLAES LQPDYSERLC LVSEIPPKGG

ALGEGPGASP CNQHSPYWAP PCYTLKPET.

In some cases, where a T-cell modulatory multimeric polypeptide of the present disclosure comprises a variant IL-2 polypeptide, a "cognate co-immunomodulatory polypeptide" is an IL-2R comprising polypeptides comprising the amino acid sequences of SEQ ID NO:16, 17, and 18.

In some cases, a variant IL-2 polypeptide exhibits reduced binding affinity to IL-2R, compared to the binding affinity of a IL-2 polypeptide comprising the amino acid sequence set forth in SEQ ID NO:15. For example, in some cases, a variant IL-2 polypeptide binds IL-2R with a binding affinity that is at least 10% less, at least 15% less, at least 20% less, at least 25%, at least 30% less, at least 35% less, at least 40% less, at least 45% less, at least 50% less, at least 55% less, at least 60% less, at least 65% less, at least 70% less, at least 75% less, at least 80% less, at least 85% less, at least 90% less, at least 95% less, or more than 95% less, than the binding affinity of an IL-2 polypeptide comprising the amino acid sequence set forth in SEQ ID NO:15 for an IL-2R (e.g., an IL-2R comprising polypeptides comprising the amino acid sequence set forth in SEQ ID NOs:16-18), when assayed under the same conditions.

In some cases, a variant IL-2 polypeptide has a binding affinity to IL-2R that is from 100 nM to 100 μM. As another example, in some cases, a variant IL-2 polypeptide has a binding affinity for IL-2R (e.g., an IL-2R comprising polypeptides comprising the amino acid sequence set forth in SEQ ID NOs:16-18) that is from about 100 nM to 150 nM, from about 150 nM to about 200 nM, from about 200 nM to about 250 nM, from about 250 nM to about 300 nM, from about 300 nM to about 350 nM, from about 350 nM to about 400 nM, from about 400 nM to about 500 nM, from about 500 nM to about 600 nM, from about 600 nM to about 700 nM, from about 700 nM to about 800 nM, from about 800 nM to about 900 nM, from about 900 nM to about 1 μM, to about 1 μM to about 5 μM, from about 5 μM to about 10 μM, from about 10 μM to about 15 μM, from about 15 μM to about 20 μM, from about 20 μM to about 25 μM, from about 25 μM to about 50 μM, from about 50 μM to about 75 μM, or from about 75 μM to about 100 μM.

In some cases, a variant IL-2 polypeptide has a single amino acid substitution compared to the IL-2 amino acid sequence set forth in SEQ ID NO:15. In some cases, a variant IL-2 polypeptide has from 2 to 10 amino acid substitutions compared to the IL-2 amino acid sequence set forth in SEQ ID NO:15. In some cases, a variant IL-2 polypeptide has 2 amino acid substitutions compared to the IL-2 amino acid sequence set forth in SEQ ID NO:15. In some cases, a variant IL-2 polypeptide has 3 amino acid substitutions compared to the IL-2 amino acid sequence set forth in SEQ ID NO:15. In some cases, a variant IL-2 polypeptide has 4 amino acid substitutions compared to the IL-2 amino acid sequence set forth in SEQ ID NO:15. In some cases, a variant IL-2 polypeptide has 5 amino acid substitutions compared to the IL-2 amino acid sequence set forth in SEQ ID NO:15. In some cases, a variant IL-2 polypeptide has 6 amino acid substitutions compared to the IL-2 amino acid sequence set forth in SEQ ID NO:15. In some cases, a variant IL-2 polypeptide has 7 amino acid substitutions compared to the IL-2 amino acid sequence set forth in SEQ ID NO:15. In some cases, a variant IL-2 polypeptide has 8 amino acid substitutions compared to the IL-2 amino acid sequence set forth in SEQ ID NO:15. In some cases, a variant IL-2 polypeptide has 9 amino acid substitutions compared to the IL-2 amino acid sequence set forth in SEQ ID NO:15. In some cases, a variant IL-2 polypeptide has 10 amino acid substitutions compared to the IL-2 amino acid sequence set forth in SEQ ID NO:15.

Suitable IL-2 variants include a polypeptide that comprises an amino acid sequence having at least 90%, at least 95%, at least 98%, at least 99%, or 100%, amino acid sequence identity to any one of the following amino acid sequences:

APTSSSTKKT QLQLEHLLLD LQMILNGINN YKNPKLTRML TXKFYMPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:19), where X is any amino acid other than Phe. In some cases, X is Ala;

APTSSSTKKT QLQLEHLLLX LQMILNGINN YKNPKLTRML TFKFYMPKKA TELKHLQCLE

EELKPLEEVL NLAQSKNFHL RPRDLISNIN VIVLELKGSE TTFMCEYADE TATIVEFLNR WITFCQSIIS TLT (SEQ ID NO:20), where X is any amino acid other than Asp. In some cases, X is Ala;

APTSSSTKKT QLQL$\underline{X}$HLLLD LQMILNGINN YKNPKLTRML TFKFYMPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:21), where X is any amino acid other than Glu. In some cases, X is Ala;

APTSSSTKKT QLQLE$\underline{X}$LLLD LQMILNGINN YKNPKLTRML TFKFYMPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:22), where X is any amino acid other than His. In some cases, X is Ala;

APTSSSTKKT QLQLE$\underline{X}$LLLD LQMILNGINN YKNPKLTRML TFKFYMPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:22), where X is any amino acid other than His. In some cases, X is Ala. In some cases, X is Arg. In some cases, X is Asn. In some cases, X is Asp. In some cases, X is Cys. In some cases, X is Glu. In some cases, X is Gln. In some cases, X is Gly. In some cases, X is Ile. In some cases, X is Lys. In some cases, X is Leu. In some cases, X is Met. In some cases, X is Phe. In some cases, X is Pro. In some cases, X is Ser. In some cases, X is Thr. In some cases, X is Tyr. In some cases, X is Trp. In some cases, X is Val;

APTSSSTKKT QLQLEHLLLD LQMILNGINN YKNPKLTRML TFKF$\underline{X}$MPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:23), where X is any amino acid other than Tyr. In some cases, X is Ala;

APTSSSTKKT QLQLEHLLLD LQMILNGINN YKNPKLTRML TFKFYMPKKA TELKHLQCLE EELKPLEEVL NLAQSKNFHL RPRDLISNIN VIVLELKGSE TTFMCEYADE TATIVEFLNR WITFC $\underline{X}$SIIS TLT (SEQ ID NO:24), where X is any amino acid other than Gln. In some cases, X is Ala;

APTSSSTKKT QLQLE$\underline{X_1}$ LLLD LQMILNGINN YKNPKLTRML T$\underline{X_2}$ KFYMPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:25), where $X_1$ is any amino acid other than His, and where $X_2$ is any amino acid other than Phe. In some cases, $X_1$ is Ala. In some cases, $X_2$ is Ala. In some cases, $X_1$ is Ala; and $X_2$ is Ala;

APTSSSTKKT QLQLEHLLL$X_1$ LQMILNGINN YKNPKLTRML T$X_2$KFYMPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:26), where $X_1$ is any amino acid other than Asp; and where $X_2$ is any amino acid other than Phe. In some cases, $X_1$ is Ala. In some cases, $X_2$ is Ala. In some cases, $X_1$ is Ala; and $X_2$ is Ala;

APTSSSTKKT QLQL$\underline{X_1}$ HLLL$\underline{X_2}$ LQMILNGINN YKNPKLTRML T$\underline{X_3}$ KFYMPKKA TELKHLQCLE EELKPLEEVL NLAQSKNFHL RPRDLISNIN VIVLELKGSE TTFMCEYADE TATIVEFLNR WITFCQSIIS TLT(SEQ ID NO:27), where $X_1$ is any amino acid other than Glu; where $X_2$ is any amino acid other than Asp; and where $X_3$ is any amino acid other than Phe. In some cases, $X_1$ is Ala. In some cases, $X_2$ is Ala. In some cases, $X_3$ is Ala. In some cases, $X_1$ is Ala; $X_2$ is Ala; and $X_3$ is Ala;

APTSSSTKKT QLQLE$\underline{X_1}$ LLL$\underline{X_2}$ LQMILNGINN YKNPKLTRML T$\underline{X_3}$ KFYMPKKA TELKHLQCLE EELKPLEEVL NLAQSKNFHL RPRDLISNIN VIVLELKGSE TTFMCEYADE TATIVEFLNR WITFCQSIIS TLT(SEQ ID NO:28), where $X_1$ is any amino acid other than His; where $X_2$ is any amino acid other than Asp; and where $X_3$ is any amino acid other than Phe. In some cases, $X_1$ is Ala. In some cases, $X_2$ is Ala. In some cases, $X_3$ is Ala. In some cases, $X_1$ is Ala; $X_2$ is Ala; and $X_3$ is Ala;

APTSSSTKKT QLQLEHLLL$\underline{X_1}$ LQMILNGINN YKNPKLTRML T$\underline{X_2}$ KFYMPKKA TELKHLQCLE EELKPLEEVL NLAQSKNFHL RPRDLISNIN VIVLELKGSE TTFMCEYADE TATIVEFLNR WITF $\underline{X_3}$ SIIS TLT (SEQ ID NO:29), where $X_1$ is any amino acid other than Asp; where $X_2$ is any amino acid other than Phe; and where $X_3$ is any amino acid other than Gln. In some cases, $X_1$ is Ala. In some cases, $X_2$ is Ala. In some cases, $X_3$ is Ala. In some cases, $X_1$ is Ala; $X_2$ is Ala; and $X_3$ is Ala;

APTSSSTKKT QLQLEHLLL$\underline{X_1}$ LQMILNGINN YKNPKLTRML T$\underline{X_2}$ KF $\underline{X_3}$ MPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:30), where $X_1$ is any amino acid other than Asp; where $X_2$ is any amino acid other than Phe; and where $X_3$ is any amino acid other than Tyr. In some cases, $X_1$ is Ala. In some cases, $X_2$ is Ala. In some cases, $X_3$ is Ala. In some cases, $X_1$ is Ala; $X_2$ is Ala; and $X_3$ is Ala;

APTSSSTKKT QLQLE$\underline{X_1}$ LLL$\underline{X_2}$ LQMILNGINN YKNPKLTRML T$\underline{X_3}$ KF $\underline{X_4}$ MPKKA TELKHLQCLE EELKPLEEVL NLAQSKNFHL RPRDLISNIN VIVLELKGSE TTFMCEYADE TATIVEFLNR WITFCQSIIS TLT (SEQ ID NO:31), where $X_1$ is any amino acid other than His; where $X_2$ is any amino acid other than Asp; where $X_3$ is any amino acid other than Phe; and where $X_4$ is any amino acid other than Tyr. In some cases, $X_1$ is Ala. In some cases, $X_2$ is Ala. In some cases, $X_3$ is Ala. In some cases, $X_4$ is Ala. In some cases, $X_1$ is Ala; $X_2$ is Ala; $X_3$ is Ala; and $X_4$ is Ala;

APTSSSTKKT QLQLEHLLL$\underline{X_1}$ LQMILNGINN YKNPKLTRML T$\underline{X_2}$ KF $\underline{X_3}$ MPKKA TELKHLQCLE EELKPLEEVL NLAQSKNFHL RPRDLISNIN VIVLELKGSE TTFMCEYADE TATIVEFLNR WITFC $\underline{X_4}$ SIIS TLT (SEQ ID NO:32), where $X_1$ is any amino acid other than Asp; where $X_2$ is any amino acid other than Phe; where $X_3$ is any amino acid other than Tyr; and where $X_4$ is any amino acid other than Gln. In some cases, $X_1$ is Ala. In some cases, $X_2$ is Ala. In some cases, $X_3$ is Ala. In some cases, $X_4$ is Ala. In some cases, $X_1$ is Ala; $X_2$ is Ala; $X_3$ is Ala; and $X_4$ is Ala;

APTSSSTKKT QLQLE$\underline{X_1}$ LLL$\underline{X_2}$ LQMILNGINN YKNPKLTRML T$\underline{X_3}$ KF $\underline{X_4}$ MPKKA TELKHLQCLE EELKPLEEVL NLAQSKNFHL RPRDLISNIN VIVLELKGSE TTFMCEYADE TATIVEFLNR WITFC $\underline{X_5}$ SIIS TLT (SEQ ID NO:33), where $X_1$ is any amino acid other than His; where $X_2$ is any amino acid other than Asp: where $X_3$ is any amino acid other than Phe; where $X_4$ is any amino acid other than Tyr; and where $X_5$ is any amino acid other than Gln. In some cases, $X_1$ is Ala. In some cases, $X_2$ is Ala. In some cases, $X_3$ is Ala. In some cases, $X_4$ is Ala. In some cases, $X_5$ is Ala. In some cases, $X_1$ is Ala; $X_2$ is Ala; $X_3$ is Ala; $X_4$ is Ala; $X_5$ is Ala; and APTSSSTKKT QLQLE$\underline{X_1}$ LLLD LQMILNGINN YKNPKLTRML T$\underline{X_2}$ KFYMPKKA TELKHLQCLE EELKPLEEVL NLAQSKNFHL RPRDLISNIN VIVLELKGSE TTFMCEYADE TATIVEFLNR WITFC $\underline{X_3}$ SIIS TLT (SEQ ID NO:34), where $X_1$ is any amino acid other than His; where $X_2$ is any amino acid other than Phe;

and where $X_3$ is any amino acid other than Gln. In some cases, $X_1$ is Ala. In some cases, $X_2$ is Ala. In some cases, $X_3$ is Ala. In some cases, $X_1$ is Ala; $X_2$ is Ala; and $X_3$ is Ala.

Additional Polypeptides

A polypeptide chain of a multimeric polypeptide of the present disclosure can include one or more polypeptides in addition to those described above. Suitable additional polypeptides include epitope tags and affinity domains. The one or more additional polypeptide can be included at the N-terminus of a polypeptide chain of a multimeric polypeptide, at the C-terminus of a polypeptide chain of a multimeric polypeptide, or internally within a polypeptide chain of a multimeric polypeptide.

Epitope Tag

Suitable epitope tags include, but are not limited to, hemagglutinin (HA; e.g., YPYDVPDYA (SEQ ID NO:35); FLAG (e.g., DYKDDDDK (SEQ ID NO:36); c-myc (e.g., EQKLISEEDL; SEQ ID NO:37). and the like.

Affinity Domain

Affinity domains include peptide sequences that can interact with a binding partner, e.g., such as one immobilized on a solid support, useful for identification or purification. DNA sequences encoding multiple consecutive single amino acids, such as histidine, when fused to the expressed protein, may be used for one-step purification of the recombinant protein by high affinity binding to a resin column, such as nickel sepharose. Exemplary affinity domains include His5 (HHHHH) (SEQ ID NO:38), HisX6 (HHHHHH) (SEQ ID NO:39), C-myc (EQKLISEEDL) (SEQ ID NO:37), Flag (DYKDDDDK) (SEQ ID NO:36), StrepTag (WSHPQFEK) (SEQ ID NO:40), hemagglutinin, e.g., HA Tag (YPYDVPDYA) (SEQ ID NO:35), glutathione-S-transferase (GST), thioredoxin, cellulose binding domain, RYIRS (SEQ ID NO:41), Phe-His-His-Thr (SEQ ID NO:42), chitin binding domain, S-peptide, T7 peptide, SH2 domain, C-end RNA tag, WEAAAREACCRECCARA (SEQ ID NO:43), metal binding domains, e.g., zinc binding domains or calcium binding domains such as those from calcium-binding proteins, e.g., calmodulin, troponin C, calcineurin B, myosin light chain, recoverin, S-modulin, visinin, VILIP, neurocalcin, hippocalcin, frequenin, caltractin, calpain large-subunit, S100 proteins, parvalbumin, calbindin D9K, calbindin D28K, and calretinin, inteins, biotin, streptavidin, MyoD, Id, leucine zipper sequences, and maltose binding protein.

Drug Conjugates

A polypeptide chain of a multimeric polypeptide of the present disclosure can comprise a small molecule drug linked (e.g., covalently attached) to the polypeptide chain. For example, where a multimeric polypeptide of the present disclosure comprises an Fc polypeptide, the Fc polypeptide can comprise a covalently linked small molecule drug. In some cases, the small molecule drug is a cancer chemotherapeutic agent, e.g., a cytotoxic agent. A polypeptide chain of a multimeric polypeptide of the present disclosure can comprise a cytotoxic agent linked (e.g., covalently attached) to the polypeptide chain. For example, where a multimeric polypeptide of the present disclosure comprises an Fc polypeptide, the Fc polypeptide can comprise a covalently linked cytotoxic agent. Cytotoxic agents include prodrugs.

A drug (e.g., a cancer chemotherapeutic agent) can be linked directly or indirectly to a polypeptide chain of a multimeric polypeptide of the present disclosure. For example, where a multimeric polypeptide of the present disclosure comprises an Fc polypeptide, a drug (e.g., a cancer chemotherapeutic agent) can be linked directly or indirectly to the Fc polypeptide. Direct linkage can involve linkage directly to an amino acid side chain. Indirect linkage can be linkage via a linker. A drug (e.g., a cancer chemotherapeutic agent) can be linked to a polypeptide chain (e.g., an Fc polypeptide) of a multimeric polypeptide of the present disclosure via a thioether bond, an amide bond, a carbamate bond, a disulfide bond, or an ether bond.

Linkers include cleavable linkers and non-cleavable linkers. In some cases, the linker is a protease-cleavable linker. Suitable linkers include, e.g., peptides (e.g., from 2 to 10 amino acids in length; e.g., 2, 3, 4, 5, 6, 7, 8, 9, or 10 amino acids in length), alkyl chains, poly(ethylene glycol), disulfide groups, thioether groups, acid labile groups, photolabile groups, peptidase labile groups, and esterase labile groups. Non-limiting example of suitable linkers are: i) N-succinimidyl-[(N-maleimidopropionamido)-tetraethyleneglycol] ester (NHS-PEG4-maleimide); ii) N-succinimidyl 4-(2-pyridyldithio)butanoate (SPDB); N-succinimidyl 4-(2-pyridyldithio)2-sulfobutanoate (sulfo-SPDB); N-succinimidyl 4-(2-pyridyldithio) pentanoate (SPP); N-succinimidyl-4-(N-maleimidomethyl)-cyclohexane-1-carboxy-(6-amidocaproate) (LC-SMCC); κ-maleimidoundecanoic acid N-succinimidyl ester (KMUA); γ-maleimide butyric acid N-succinimidyl ester (GMBS); ε-maleiinidocaproic acid N-hydroxysuccinimide ester (EMCS); maleimide benzoyl-N-hydroxysuccinimide ester (MBS); N-(α-maleimidoacetoxy)-succinimide ester (AMAS); succinimidyl-6-(β-maleimidopropionamide)hexanoate (SMPH); N-succinimidyl 4-(p-maleimidophenyl)butyrate (SMPB); N-(p-maleimidophenyl)isocyanate (PMPI); N-succinimidyl 4(2-pyridylthio)pentanoate (SPP); N-succinimidyl(4-iodoacetyl)aminobenzoate (SIAB); 6-maleimidocaproyl (MC); maleimidopropanoyl (MP); p-aminobenzyloxycarbonyl (PAB); N-succinimidyl 4-(maleimidomethyl)cyclohexanecarboxylate (SMCC); N-succinimidyl-4-(N-maleimidomethyl)-cyclohexane-1-carboxy-(6-amidocaproate), a "long chain" analog of SMCC (LC-SMCC); 3-maleimidopropanoic acid N-succinimidyl ester (BMPS); N-succinimidyl iodoacetate (SIA); N-succinimidyl bromoacetate (SBA); and N-succinimidyl 3-(bromoacetamido)propionate (SBAP).

A polypeptide (e.g., an Fc polypeptide) can be modified with crosslinking reagents such as succinimidyl 4-(N-maleimidomethyl)-cyclohexane-1-carboxylate (SMCC), sulfo-SMCC, maleimidobenzoyl-N-hydroxysuccinimide ester (MBS), sulfo-MBS or succinimidyl-iodoacetate, as described in the literature, to introduce 1-10 reactive groups. The modified Fc polypeptide is then reacted with a thiol-containing cytotoxic agent to produce a conjugate.

For example, where a multimeric polypeptide of the present disclosure comprises an Fc polypeptide, the polypeptide chain comprising the Fc polypeptide can be of the formula (A)-(L)-(C), where (A) is the polypeptide chain comprising the Fc polypeptide; where (L), if present, is a linker; and where (C) is a cytotoxic agent. (L), if present, links (A) to (C). In some cases, the polypeptide chain comprising the Fc polypeptide can comprise more than one cytotoxic agent (e.g., 2, 3, 4, or 5, or more than 5, cytotoxic agents).

Suitable drugs include, e.g., rapamycin. Suitable drugs include, e.g., retinoids, such as all-trans retinoic acid (ATRA); vitamin D3; a vitamin D3 analog; and the like. As noted above, in some cases, a drug is a cytotoxic agent. Cytotoxic agents are known in the art. A suitable cytotoxic agent can be any compound that results in the death of a cell, or induces cell death, or in some manner decreases cell viability, and includes, for example, maytansinoids and maytansinoid analogs, benzodiazepines, taxoids, CC-1065 and CC-1065 analogs, duocarmycins and duocarmycin analogs, enediynes, such as calicheamicins, dolastatin and dolastatin analogs including auristatins, tomaymycin derivatives, leptomycin derivatives, methotrexate, cisplatin, carboplatin, daunorubicin, doxorubicin, vincristine, vinblastine, melphalan, mitomycin C, chlorambucil and morpholino doxorubicin.

For example, in some cases, the cytotoxic agent is a compound that inhibits microtubule formation in eukaryotic cells. Such agents include, e.g., maytansinoid, benzodiazepine, taxoid, CC-1065, duocarmycin, a duocarmycin analog, calicheamicin, dolastatin, a dolastatin analog, auristatin, tomaymycin, and leptomycin, or a pro-drug of any one of the foregoing. Maytansinoid compounds include, e.g., N(2')-deacetyl-N(2')-(3-mercapto-1-oxopropyl)-maytansine (DM1); N(2')-deacetyl-N(2')-(4-mercapto-1-oxopentyl)-maytansine (DM3); and N(2')-deacetyl-N2-(4-mercapto-4-methyl-1-oxopentyl)-maytansine (DM4). Benzodiazepines include, e.g., indolinobenzodiazepines and oxazolidinobenzodiazepines.

Cytotoxic agents include taxol; cytochalasin B; gramicidin D; ethidium bromide; emetine; mitomycin; etoposide; tenoposide; vincristine; vinblastine; colchicin; doxorubicin; daunorubicin; dihydroxy anthracin dione; maytansine or an analog or derivative thereof; an auristatin or a functional peptide analog or derivative thereof; dolastatin 10 or 15 or an analogue thereof; irinotecan or an analogue thereof; mitoxantrone; mithramycin; actinomycin D; 1-dehydrotestosterone; a glucocorticoid; procaine; tetracaine; lidocaine; propranolol; puromycin; calicheamicin or an analog or derivative thereof; an antimetabolite; 6 mercaptopurine; 6 thioguanine; cytarabine; fludarabin; 5 fluorouracil; decarbazine; hydroxyurea; asparaginase; gemcitabine; cladribine; an alkylating agent; a platinum derivative; duocarmycin A; duocarmycin SA; rachelmycin (CC-1065) or an analog or derivative thereof; an antibiotic; pyrrolo[2,1-c][1,4]-benzodiazepines (PDB); diphtheria toxin; ricin toxin; cholera toxin; a Shiga-like toxin; LT toxin; C3 toxin; Shiga toxin; pertussis toxin; tetanus toxin; soybean Bowman-Birk protease inhibitor; Pseudomonas exotoxin; alorin; saporin; modeccin; gelanin; abrin A chain; modeccin A chain; alpha-sarcin; *Aleurites fordii* proteins; dianthin proteins; *Phytolacca americana* proteins; *Momordica charantia* inhibitor; curcin; crotin; *Sapaonaria officinalis* inhibitor; gelonin; mitogellin; restrictocin; phenomycin; enomycin toxins; ribonuclease (RNase); DNase I; Staphylococcal enterotoxin A; pokeweed antiviral protein; diphtheria toxin; and Pseudomonas endotoxin.

Non-Limiting Examples

Figure 9A:
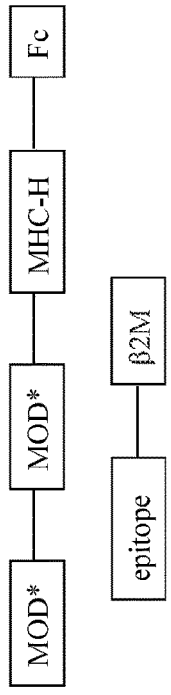
FIG. 9A-9D are schematic depictions of various T-cell modulatory multimeric polypeptide of the present disclosure.
Figure 9B:
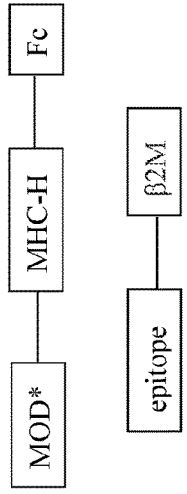
Figure 9C:
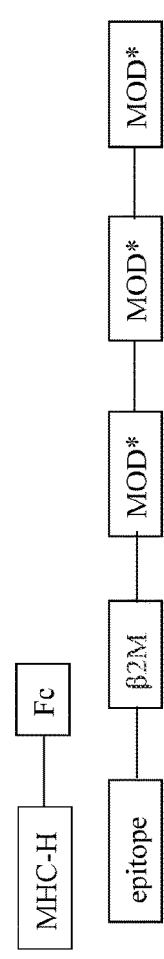
Figure 9D:
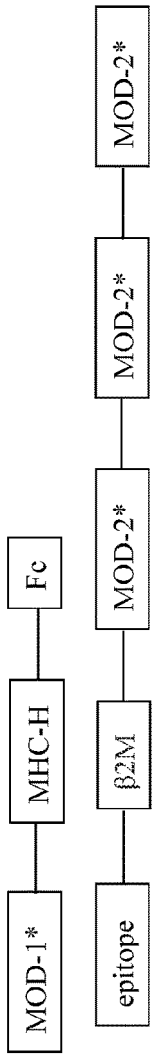
Figure 10A:
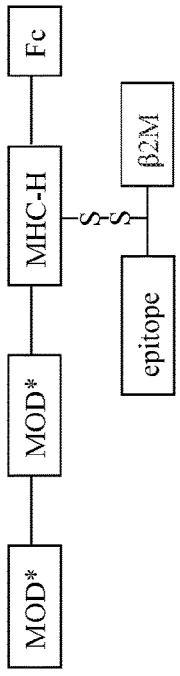
FIG. 10A-10D are schematic depictions of various disulfide-linked T-cell modulatory multimeric polypeptide of the present disclosure.
Figure 10B:
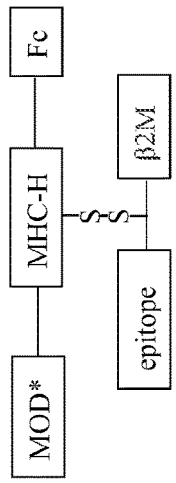
Figure 10C:
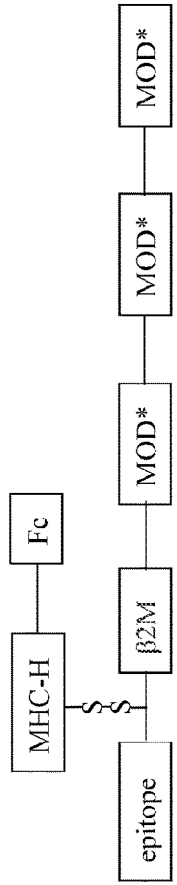
Figure 10D:
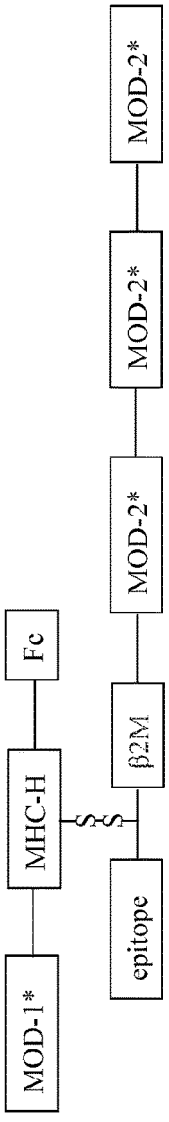

Non-limiting examples of configurations of T-cell modulatory multimeric polypeptides of the present disclosure are depicted schematically in FIG. 9A-9D. Non-limiting examples of configurations of disulfide-linked T-cell modulatory multimeric polypeptides of the present disclosure are depicted schematically in FIG. 10A-10D.

Non-limiting examples of nucleotide sequences encoding a first polypeptide chain or a second polypeptide chain of a T-cell modulatory multimeric polypeptide of the present disclosure are depicted in FIG. 11A, FIG. 11C, FIG. 12A, FIG. 12C, FIG. 13A, FIG. 13C, FIG. 14A, FIG. 14C, FIG. 15A, FIG. 15C, FIG. 16A, FIG. 16C, FIG. 17A, FIG. 17C, FIG. 18A, FIG. 18C, FIG. 19A, FIG. 19C, FIG. 20A, FIG. 20C, FIG. 21A, and FIG. 21C. Non-limiting examples of amino acid sequences of a first polypeptide chain or a second polypeptide chain of a T-cell modulatory multimeric polypeptide of the present disclosure are depicted in FIG. 11B, FIG. 11D, FIG. 12B, FIG. 12D, FIG. 13B, FIG. 13D, FIG. 14B, FIG. 14D, FIG. 15B, FIG. 15D, FIG. 16B, FIG. 16D, FIG. 17B, FIG. 17D, FIG. 18B, FIG. 18D, FIG. 19B, FIG. 19D, FIG. 20B, FIG. 20D, FIG. 21B, and FIG. 21D. Non-limiting examples of amino acid sequences of a first polypeptide chain or a second polypeptide chain of a T-cell modulatory multimeric polypeptide of the present disclosure are depicted in FIG. 22A, 22B, and 23A-23E.

The polypeptide depicted in FIG. 12B can be modified by swapping out the FLPSDFFPSV (SEQ ID NO:238) epitope with a different epitope. Similarly, the polypeptide depicted in FIG. 15B can be modified by swapping out the FLPSDFFPSV (SEQ ID NO:238) epitope with a different epitope. Similarly, the polypeptide depicted in FIG. 16B can be modified by swapping out the HBV Pol epitope with a different epitope.

In some cases, a T-cell modulatory multimeric polypeptide of the present disclosure can comprise (with polypeptide designations in parentheses following the figure numbers):

a) a heterodimeric polypeptide comprising: i) a polypeptide comprising the amino acid sequence depicted in FIG. 11B ("1644"); and ii) a polypeptide comprising the amino acid sequence depicted in FIG. 12B ("1938"); or b) a heterodimeric polypeptide comprising: i) a polypeptide comprising the amino acid sequence depicted in FIG. 11D ("2572"); and ii) a polypeptide comprising the amino acid sequence depicted in FIG. 12D ("2452"); or c) a heterodimeric polypeptide comprising: i) a polypeptide comprising the amino acid sequence depicted in FIG. 13B ("1380"); and ii) a polypeptide comprising the amino acid sequence depicted in FIG. 12B ("1938); or d) a heterodimeric polypeptide comprising: i) a polypeptide comprising the amino acid sequence depicted in FIG. 13D ("1715"); and ii) a polypeptide comprising the amino acid sequence depicted in FIG. 12D ("2452); or e) a heterodimeric polypeptide comprising: i) a polypeptide comprising the amino acid sequence depicted in FIG. 14B ("2316"); and ii) a polypeptide comprising the amino acid sequence depicted in FIG. 12B ("1938"); or f) a heterodimeric polypeptide comprising: i) a polypeptide comprising the amino acid sequence depicted in FIG. 14D ("2456"); and ii) a polypeptide comprising the amino acid sequence depicted in FIG. 12D ("2452"); or g) a heterodimeric polypeptide comprising: i) a polypeptide comprising the amino acid sequence depicted in FIG. 11B ("1644"); and ii) a polypeptide comprising the amino acid sequence depicted in FIG. 15B ("2453"); or h) a heterodimeric polypeptide comprising: i) a polypeptide comprising the amino acid sequence depicted in FIG. 11D ("2572"); and ii) a polypeptide comprising the amino acid sequence depicted in FIG. 15D ("2454"); or i) a heterodimeric polypeptide comprising: i) a polypeptide comprising the amino acid sequence depicted in FIG. 14B ("2316"); and ii) a polypeptide comprising the amino acid sequence depicted in FIG. 15B ("2453"); or j) a heterodimeric polypeptide comprising: i) a polypeptide comprising the amino acid sequence depicted in FIG. 14D ("2456"); and ii) a polypeptide comprising the amino acid sequence depicted in FIG. 15D ("2454"); or k) a heterodimeric polypeptide comprising: i) a polypeptide comprising the amino acid sequence depicted in FIG. 13B ("1380"); and ii) a polypeptide comprising the amino acid sequence depicted in FIG. 16B ("839"); or l) a heterodimeric polypeptide comprising: i) a polypeptide comprising the amino acid sequence depicted in FIG. 13D ("1715"); and ii) a polypeptide comprising the amino acid sequence depicted in FIG. 16D ("1717"); or m) a heterodimeric polypeptide comprising: i) a polypeptide comprising the amino acid sequence depicted in FIG. 13B ("1380"); and ii) a polypeptide comprising the amino acid sequence depicted in FIG. 17B ("2723"); or n) a heterodimeric polypeptide comprising: i) a polypeptide comprising the amino acid sequence depicted in FIG. 13D ("1715"); and ii) a polypeptide comprising the amino acid sequence depicted in FIG. 17D ("2724"); or o) a heterodimeric polypeptide comprising: i) a polypeptide comprising the amino acid sequence depicted in FIG. 14B ("2316"); and ii) a polypeptide comprising the amino acid sequence depicted in FIG. 17B ("2723"); or p) a heterodimeric polypeptide comprising: i) a polypeptide comprising the amino acid sequence depicted in FIG. 14D ("2456"); and ii) a polypeptide comprising the amino acid sequence depicted in FIG. 17D ("2724"); or q) a heterodimeric polypeptide comprising: i) a polypeptide comprising the amino acid sequence depicted in FIG. 13B ("1380"); and ii) a polypeptide comprising the amino acid sequence depicted in FIG. 18B ("2725"); or r) a heterodimeric polypeptide comprising: i) a polypeptide comprising the amino acid sequence depicted in FIG. 13D ("1715"); and ii) a polypeptide comprising the amino acid sequence depicted in FIG. 18D ("2726"); or s) a heterodimeric polypeptide comprising: i) a polypeptide comprising the amino acid sequence depicted in FIG. 14B ("2316"); and ii) a polypeptide comprising the amino acid sequence depicted in FIG. 18B ("2725"); or t) a heterodimeric polypeptide comprising: i) a polypeptide comprising the amino acid sequence depicted in FIG. 14D ("2456"); and ii) a polypeptide comprising the amino acid sequence depicted in FIG. 18D ("2726"); or u) a heterodimeric polypeptide comprising: i) a polypeptide comprising the amino acid sequence depicted in FIG. 13B ("1380"); and ii) a polypeptide comprising the amino acid sequence depicted in FIG. 19B ("2727"); or v) a heterodimeric polypeptide comprising: i) a polypeptide comprising the amino acid sequence depicted in FIG. 13D ("1715"); and ii) a polypeptide comprising the amino acid sequence depicted in FIG. 19D ("2728"); or w) a heterodimeric polypeptide comprising: i) a polypeptide comprising the amino acid sequence depicted in FIG. 14B ("2316"); and ii) a polypeptide comprising the amino acid sequence depicted in FIG. 19B ("2727"); or x) a heterodimeric polypeptide comprising: i) a polypeptide comprising the amino acid sequence depicted in FIG. 14D ("2456"); and ii) a polypeptide comprising the amino acid sequence depicted in FIG. 19D ("2728"); or y) a heterodimeric polypeptide comprising: i) a polypeptide comprising the amino acid sequence depicted in FIG. 13B ("1380"); and ii) a polypeptide comprising the amino acid sequence depicted in FIG. 20B ("2729"); or z) a heterodimeric polypeptide comprising: i) a polypeptide comprising the amino acid sequence depicted in FIG. 13D ("1715"); and ii) a polypeptide comprising the amino acid sequence depicted in FIG. 20D ("2730"); or aa) a heterodimeric polypeptide comprising: i) a polypeptide comprising the amino acid sequence depicted in FIG. 14B ("2316"); and ii) a polypeptide comprising the amino acid sequence depicted in FIG. 20B ("2729"); or bb) a heterodimeric polypeptide comprising: i) a polypeptide comprising the amino acid sequence depicted in FIG. 14D ("2456"); and ii) a polypeptide comprising the amino acid sequence depicted in FIG. 20D ("2730"); or cc) a heterodimeric polypeptide comprising: i) a polypeptide comprising the amino acid sequence depicted in FIG. 13B ("1380"); and ii) a polypeptide comprising the amino acid sequence depicted in FIG. 21B ("2731"); or dd) a heterodimeric polypeptide comprising: i) a polypeptide comprising the amino acid sequence depicted in FIG. 13D ("1715"); and ii) a polypeptide comprising the amino acid sequence depicted in FIG. 21D ("2732"); or ee) a heterodimeric polypeptide comprising: i) a polypeptide comprising the amino acid sequence depicted in FIG. 14B ("2316"); and ii) a polypeptide comprising the amino acid sequence depicted in FIG. 21B ("2731"); or ff) a heterodimeric polypeptide comprising: i) a polypeptide comprising the amino acid sequence depicted in FIG. 14D ("2456"); and ii) a polypeptide comprising the amino acid sequence depicted in FIG. 21D ("2732").

In some cases, a multimeric polypeptide of the present disclosure comprises: a) the polypeptide designated 1777 in FIG. 22A, without the MYRMQLLSCIALSLALVTNS (SEQ ID NO:357) signal; and b) any one of the polypeptides depicted in FIG. 23A-23C and designated 1783, 1784, and 1785, without the MSRSVALAVLALLSLSGLEA (SEQ ID NO:358) leader peptide.

In some cases, a multimeric polypeptide of the present disclosure comprises: a) the polypeptide designated 1781 in FIG. 22B, without the MYRMQLLSCIALSLALVTNS (SEQ ID NO:357) signal; and b) any one of the polypeptides depicted in FIG. 23A-23C and designated 1783, 1784, and 1785, without the MSRSVALAVLALLSLSGLEA (SEQ ID NO:358) leader peptide.

Methods of Generating a Multimeric T-Cell Modulatory Polypeptide

The present disclosure provides a method of obtaining a T-cell modulatory multimeric polypeptide comprising one or more variant immunomodulatory polypeptides that exhibit lower affinity for a cognate co-immunomodulatory polypeptide compared to the affinity of the corresponding parental wild-type immunomodulatory polypeptide for the co-immunomodulatory polypeptide, the method comprising: A) generating a library of T-cell modulatory multimeric polypeptides comprising a plurality of members, wherein each member comprises: a) a first polypeptide comprising: i) an epitope; and ii) a first major MHC polypeptide; and b) a second polypeptide comprising: i) a second MHC polypeptide; and ii) optionally an Ig Fc polypeptide or a non-Ig scaffold, wherein each member comprises a different variant immunomodulatory polypeptide on the first polypeptide, the second polypeptide, or both the first and the second polypeptide; B) determining the affinity of each member of the library for a cognate co-immunomodulatory polypeptide; and C) selecting a member that exhibits reduced affinity for the cognate co-immunomodulatory polypeptide. In some cases, the affinity is determined by bio-layer interferometry (BLI) using purified T-cell modulatory multimeric polypeptide library members and the cognate co-immunomodulatory polypeptide. BLI methods are well known to those skilled in the art. A BLI assay is described above. See, e.g., Lad et al. (2015) *J. Biomol. Screen.* 20(4): 498-507; and Shah and Duncan (2014) *J. Vis. Exp.* 18:e51383.

The present disclosure provides a method of obtaining a T-cell modulatory multimeric polypeptide that exhibits selective binding to a T-cell, the method comprising: A) generating a library of T-cell modulatory multimeric polypeptides comprising a plurality of members, wherein each member comprises: a) a first polypeptide comprising: i) an epitope; and ii) a first MHC polypeptide; and b) a second polypeptide comprising: i) a second MHC polypeptide; and ii) optionally an immunoglobulin (Ig) Fc polypeptide or a non-Ig scaffold, wherein each member comprises a different variant immunomodulatory polypeptide on the first polypeptide, the second polypeptide, or both the first and the second polypeptide, wherein the variant immunomodulatory polypeptide differs in amino acid sequence by from 1 amino acid to 10 amino acids from a parental wild-type immunomodulatory polypeptide; B) contacting a T-cell modulatory multimeric polypeptide library member with a target T-cell expressing on its surface: i) a cognate co-immunomodulatory polypeptide that binds the parental wild-type immunomodulatory polypeptide; and ii) a T-cell receptor that binds to the epitope, wherein the T-cell modulatory multimeric polypeptide library member comprises an epitope tag, such that the T-cell modulatory multimeric polypeptide library member binds to the target T-cell; C) contacting the T-cell modulatory multimeric polypeptide library member bound to the target T-cell with a fluorescently labeled binding agent that binds to the epitope tag, generating a T-cell modulatory multimeric polypeptide library member/target T-cell/binding agent complex; D) measuring the mean fluorescence intensity (MFI) of the T-cell modulatory multimeric polypeptide library member/target T-cell/binding agent complex using flow cytometry, wherein the MFI measured over a range of concentrations of the T-cell modulatory multimeric polypeptide library member provides a measure of the affinity and apparent avidity; and E) selecting a T-cell modulatory multimeric polypeptide library member that selectively binds the target T cell, compared to binding of the T-cell modulatory multimeric polypeptide library member to a control T cell that comprises: i) the cognate co-immunomodulatory polypeptide that binds the parental wild-type immunomodulatory polypeptide; and ii) a T-cell receptor that binds to an epitope other than the epitope present in the T-cell modulatory multimeric polypeptide library member. In some cases, a T-cell modulatory multimeric polypeptide library member that is identified as selectively binds to a target T cell is isolated from the library.

In some cases, a parental wild-type immunomodulatory polypeptide and cognate immunomodulatory polypeptide pairs are selected from:

IL-2 and IL-2 receptor;
4-1BBL and 4-1BB;
PD-L1 and PD-1;
FasL and Fas;
TGFβ and TGFβ receptor;
CD80 and CD28;
CD86 and CD28;
OX40L and OX40;
FasL and Fas;
ICOS-L and ICOS;
ICAM and LFA-1;
JAG1 and Notch;
JAG1 and CD46;
CD80 and CTLA4; and
CD86 and CTLA4.

The present disclosure provides a method of obtaining a T-cell modulatory multimeric polypeptide comprising one or more variant immunomodulatory polypeptides that exhibit reduced affinity for a cognate co-immunomodulatory polypeptide compared to the affinity of the corresponding parental wild-type immunomodulatory polypeptide for the co-immunomodulatory polypeptide, the method comprising selecting, from a library of T-cell modulatory multimeric polypeptides comprising a plurality of members, a member that exhibits reduced affinity for the cognate co-immunomodulatory polypeptide, wherein the plurality of member comprises: a) a first polypeptide comprising: i) an epitope; and ii) a first MHC polypeptide; and h) a second polypeptide comprising: i) a second MHC polypeptide; and ii) optionally an Ig Fc polypeptide or a non-Ig scaffold, wherein the members of the library comprise a plurality of variant immunomodulatory polypeptide present in the first polypeptide, the second polypeptide, or both the first and the second polypeptide. In some cases, the selecting step comprises determining the affinity, using bio-layer interferometry, of binding between T-cell modulatory multimeric polypeptide library members and the cognate co-immunomodulatory polypeptide. In some cases, the T-cell modulatory multimeric polypeptide is as described above.

In some cases, the method further comprises: a) contacting the selected T-cell modulatory multimeric polypeptide library member with a target T-cell expressing on its surface: i) a cognate co-immunomodulatory polypeptide that binds the parental wild-type immunomodulatory polypeptide; and ii) a T-cell receptor that binds to the epitope, wherein the T-cell modulatory multimeric polypeptide library member comprises an epitope tag, such that the T-cell modulatory multimeric polypeptide library member binds to the target T-cell; b) contacting the selected T-cell modulatory multimeric polypeptide library member bound to the target T-cell with a fluorescently labeled binding agent that binds to the epitope tag, generating a selected T-cell modulatory multimeric polypeptide library member/target T-cell/binding agent complex; and c) measuring the mean fluorescence intensity (MFT) of the selected T-cell modulatory multimeric polypeptide library member/target T-cell/binding agent complex using flow cytometry, wherein the MFI measured over a range of concentrations of the selected T-cell modulatory multimeric polypeptide library member provides a measure of the affinity and apparent avidity. A selected T-cell modulatory multimeric polypeptide library member that selectively binds the target T cell, compared to binding of the T-cell modulatory multimeric polypeptide library member to a control T cell that comprises: i) the cognate co-immunomodulatory polypeptide that binds the parental wild-type immunomodulatory polypeptide; and ii) a T-cell receptor that binds to an epitope other than the epitope present in the T-cell modulatory multimeric polypeptide library member, is identified as selectively binding to the target T cell. In some cases, the binding agent is an antibody specific for the epitope tag. In some cases, the variant immunomodulatory polypeptide comprises from 1 to 20 amino acid substitutions (e.g., 1, 2, 3, 4, 5, 6, 7, 8, 9, 10, 11, 12, 13, 14, 15, 16, 17, 18, 19, or 20 amino acid substitutions) compared to the corresponding parental wild-type immunomodulatory polypeptide. In some cases, the T-cell modulatory multimeric polypeptide comprises two variant immunomodulatory polypeptides. In some cases, the two variant immunomodulatory polypeptides comprise the same amino acid sequence. In some cases, the first polypeptide comprises one of the two variant immunomodulatory polypeptides and wherein the second polypeptide comprises the second of the two variant immunomodulatory polypeptides. In some cases, the two variant immunomodulatory polypeptides are on the same polypeptide chain of the T-cell modulatory multimeric polypeptide. In some cases, the two variant immunomodulatory polypeptides are on the first polypeptide of the T-cell modulatory multimeric polypeptide. In some cases, the two variant immunomodulatory polypeptides are on the second polypeptide of the T-cell modulatory multimeric polypeptide.

In some cases, the method further comprises isolating the selected T-cell modulatory multimeric polypeptide library member from the library. In some cases, the method further comprises providing a nucleic acid comprising a nucleotide sequence encoding the selected T-cell modulatory multimeric polypeptide library member. In some cases, the nucleic acid is present in a recombinant expression vector. In some cases, the nucleotide sequence is operably linked to a transcriptional control element that is functional in a eukaryotic cell. In some cases, the method further comprises introducing the nucleic acid into a eukaryotic host cell, and culturing the cell in a liquid medium to synthesize the encoded selected T-cell modulatory multimeric polypeptide library member in the cell. In some cases, the method further comprises isolating the synthesized selected T-cell modulatory multimeric polypeptide library member from the cell or from liquid culture medium comprising the cell. In some cases, the selected T-cell modulatory multimeric polypeptide library member comprises an Ig Fc polypeptide. In some cases, the method further comprises conjugating a drug to the Ig Fc polypeptide. In some cases, the drug is a cytotoxic agent is selected from maytansinoid, benzodiazepine, taxoid, CC-1065, duocarmycin, a duocarmycin analog, calicheamicin, dolastatin, a dolastatin analog, auristatin, tomaymycin, and leptomycin, or a pro-drug of any one of the foregoing. In some cases, the drug is a retinoid. In some cases, the parental wild-type immunomodulatory polypeptide and the cognate immunomodulatory polypeptides are selected from: IL-2 and IL-2 receptor; 4-1BBL and 4-1BB; PD-L1 and PD-1; FasL and Fas; TGFβ and TGFβ receptor; CD80 and CD28; CD86 and CD28; OX40L and OX40; FasL and Fas; ICOS-L and ICOS; ICAM and LFA-1; JAG1 and Notch; JAG1 and CD46; CD80 and CTLA4; and CD86 and CTLA4.

The present disclosure provides a method of obtaining a T-cell modulatory multimeric polypeptide comprising one or more variant immunomodulatory polypeptides that exhibit reduced affinity for a cognate co-immunomodulatory polypeptide compared to the affinity of the corresponding parental wild-type immunomodulatory polypeptide for the co-immunomodulatory polypeptide, the method comprising: A) providing a library of T-cell modulatory multimeric polypeptides comprising a plurality of members, wherein the plurality of member comprises: a) a first polypeptide comprising: i) an epitope; and ii) a first MHC polypeptide; and b) a second polypeptide comprising: i) a second MHC polypeptide; and ii) optionally an Ig Fc polypeptide or a non-Ig scaffold, wherein the members of the library comprise a plurality of variant immunomodulatory polypeptide present in the first polypeptide, the second polypeptide, or both the first and the second polypeptide; and B) selecting from the library a member that exhibits reduced affinity for the cognate co-immunomodulatory polypeptide. In some cases, the selecting step comprises determining the affinity, using bio-layer interferometry, of binding between T-cell modulatory multimeric polypeptide library members and the cognate co-immunomodulatory polypeptide. In some cases, the selecting step comprises determining the affinity, using bio-layer interferometry, of binding between T-cell modulatory multimeric polypeptide library members and the cognate co-immunomodulatory polypeptide. In some cases, the T-cell modulatory multimeric polypeptide is as described above.

In some cases, the method further comprises: a) contacting the selected T-cell modulatory multimeric polypeptide library member with a target T-cell expressing on its surface: i) a cognate co-immunomodulatory polypeptide that binds the parental wild-type immunomodulatory polypeptide; and ii) a T-cell receptor that binds to the epitope, wherein the T-cell modulatory multimeric polypeptide library member comprises an epitope tag, such that the T-cell modulatory multimeric polypeptide library member binds to the target T-cell; b) contacting the selected T-cell modulatory multimeric polypeptide library member bound to the target T-cell with a fluorescently labeled binding agent that binds to the epitope tag, generating a selected T-cell modulatory multimeric polypeptide library member/target T-cell/binding agent complex; and c) measuring the mean fluorescence intensity (MFI) of the selected T-cell modulatory multimeric polypeptide library member/target T-cell/binding agent complex using flow cytometry, wherein the MFI measured over a range of concentrations of the selected T-cell modulatory multimeric polypeptide library member provides a measure of the affinity and apparent avidity. A selected T-cell modulatory multimeric polypeptide library member that selectively binds the target T cell, compared to binding of the T-cell modulatory multimeric polypeptide library member to a control T cell that comprises: i) the cognate co-immunomodulatory polypeptide that binds the parental wild-type immunomodulatory polypeptide; and ii) a T-cell receptor that binds to an epitope other than the epitope present in the T-cell modulatory multimeric polypeptide library member, is identified as selectively binding to the target T cell. In some cases, the binding agent is an antibody specific for the epitope tag. In some cases, the variant immunomodulatory polypeptide comprises from 1 to 20 amino acid substitutions (e.g., 1, 2, 3, 4, 5, 6, 7, 8, 9, 10, 11, 12, 13, 14, 15, 16, 17, 18, 19, or 20 amino acid substitutions) compared to the corresponding parental wild-type immunomodulatory polypeptide. In some cases, the T-cell modulatory multimeric polypeptide comprises two variant immunomodulatory polypeptides. In some cases, the two variant immunomodulatory polypeptides comprise the same amino acid sequence. In some cases, the first polypeptide comprises one of the two variant immunomodulatory polypeptides and wherein the second polypeptide comprises the second of the two variant immunomodulatory polypeptides. In some cases, the two variant immunomodulatory polypeptides are on the same polypeptide chain of the T-cell modulatory multimeric polypeptide. In some cases, the two variant immunomodulatory polypeptides are on the first polypeptide of the T-cell modulatory multimeric polypeptide. In some cases, the two variant immunomodulatory polypeptides are on the second polypeptide of the T-cell modulatory multimeric polypeptide.

In some cases, the method further comprises isolating the selected T-cell modulatory multimeric polypeptide library member from the library. In some cases, the method further comprises providing a nucleic acid comprising a nucleotide sequence encoding the selected T-cell modulatory multimeric polypeptide library member. In some cases, the nucleic acid is present in a recombinant expression vector. In some cases, the nucleotide sequence is operably linked to a transcriptional control element that is functional in a eukaryotic cell. In some cases, the method further comprises introducing the nucleic acid into a eukaryotic host cell, and culturing the cell in a liquid medium to synthesize the encoded selected T-cell modulatory multimeric polypeptide library member in the cell. In some cases, the method further comprises isolating the synthesized selected T-cell modulatory multimeric polypeptide library member from the cell or from liquid culture medium comprising the cell. In some cases, the selected T-cell modulatory multimeric polypeptide library member comprises an Ig Fc polypeptide. In some cases, the method further comprises conjugating a drug to the Ig Fc polypeptide. In some cases, the drug is a cytotoxic agent is selected from maytansinoid, benzodiazepine, taxoid, CC-1065, duocarmycin, a duocarmycin analog, calicheamicin, dolastatin, a dolastatin analog, auristatin, tomaymycin, and leptomycin, or a pro-drug of any one of the foregoing. In some cases, the drug is a retinoid. In some cases, the parental wild-type immunomodulatory polypeptide and the cognate immunomodulatory polypeptides are selected from: IL-2 and IL-2 receptor; 4-1BBL and 4-1BB; PD-L1 and PD-1; FasL and Fas; TGFβ and TGFβ receptor; CD80 and CD28; CD86 and CD28; OX40L and OX40; FasL and Fas; ICOS-L and ICOS; ICAM and LFA-1; JAG1 and Notch; JAG1 and CD46; CD80 and CTLA4; and CD86 and CTLA4.

Nucleic Acids

The present disclosure provides a nucleic acid comprising a nucleotide sequence encoding a T-cell modulatory multimeric polypeptide of the present disclosure. The present disclosure provides a nucleic acid comprising a nucleotide sequence encoding a T-cell modulatory multimeric polypeptide of the present disclosure.

The present disclosure provides nucleic acids comprising nucleotide sequences encoding a multimeric polypeptide of the present disclosure. In some cases, the individual polypeptide chains of a multimeric polypeptide of the present disclosure are encoded in separate nucleic acids. In some cases, all polypeptide chains of a multimeric polypeptide of the present disclosure are encoded in a single nucleic acid. In some cases, a first nucleic acid comprises a nucleotide sequence encoding a first polypeptide of a multimeric polypeptide of the present disclosure; and a second nucleic acid comprises a nucleotide sequence encoding a second polypeptide of a multimeric polypeptide of the present disclosure. In some cases, single nucleic acid comprises a nucleotide sequence encoding a first polypeptide of a multimeric polypeptide of the present disclosure and a second polypeptide of a multimeric polypeptide of the present disclosure.

Separate Nucleic Acids Encoding Individual Polypeptide Chains of a Multimeric Polypeptide The present disclosure provides nucleic acids comprising nucleotide sequences encoding a multimeric polypeptide of the present disclosure. As noted above, in some cases, the individual polypeptide chains of a multimeric polypeptide of the present disclosure are encoded in separate nucleic acids. In some cases, nucleotide sequences encoding the separate polypeptide chains of a multimeric polypeptide of the present disclosure are operably linked to transcriptional control elements, e.g., promoters, such as promoters that are functional in a eukaryotic cell, where the promoter can be a constitutive promoter or an inducible promoter.

The present disclosure provides a first nucleic acid and a second nucleic acid, where the first nucleic acid comprises a nucleotide sequence encoding a first polypeptide of a multimeric polypeptide of the present disclosure, where the first polypeptide comprises, in order from N-terminus to C-terminus: a) an epitope (e.g., a T-cell epitope); b) a first MHC polypeptide: and c) an immunomodulatory polypeptide (e.g., a reduced-affinity variant, as described above); and where the second nucleic acid comprises a nucleotide sequence encoding a second polypeptide of a multimeric polypeptide of the present disclosure, where the second polypeptide comprises, in order from N-terminus to C-terminus: a) a second MHC polypeptide; and b) an Ig Fc polypeptide. Suitable T-cell epitopes, MHC polypeptides, immunomodulatory polypeptides, and Ig Fc polypeptides, are described above. In some cases, the nucleotide sequences encoding the first and the second polypeptides are operably linked to transcriptional control elements. In some cases, the transcriptional control element is a promoter that is functional in a eukaryotic cell. In some cases, the nucleic acids are present in separate expression vectors.

The present disclosure provides a first nucleic acid and a second nucleic acid, where the first nucleic acid comprises a nucleotide sequence encoding a first polypeptide of a multimeric polypeptide of the present disclosure, where the first polypeptide comprises, in order from N-terminus to C-terminus: a) an epitope (e.g., a T-cell epitope); and b) a first MHC polypeptide; and where the second nucleic acid comprises a nucleotide sequence encoding a second polypeptide of a multimeric polypeptide of the present disclosure, where the second polypeptide comprises, in order from N-terminus to C-terminus: a) an immunomodulatory polypeptide (e.g., a reduced-affinity variant as described above); b) a second MHC polypeptide; and c) an Ig Fc polypeptide. Suitable T-cell epitopes, MHC polypeptides, immunomodulatory polypeptides, and Ig Fc polypeptides, are described above. In some cases, the nucleotide sequences encoding the first and the second polypeptides are operably linked to transcriptional control elements. In some cases, the transcriptional control element is a promoter that is functional in a eukaryotic cell. In some cases, the nucleic acids are present in separate expression vectors.

Nucleic Acid Encoding Two or More Polypeptides Present in a Multimeric Polypeptide The present disclosure provides a nucleic acid comprising nucleotide sequences encoding at least the first polypeptide and the second polypeptide of a multimeric polypeptide of the present disclosure. In some cases, where a multimeric polypeptide of the present disclosure includes a first, second, and third polypeptide, the nucleic acid includes a nucleotide sequence encoding the first, second, and third polypeptides. In some cases, the nucleotide sequences encoding the first polypeptide and the second polypeptide of a multimeric polypeptide of the present disclosure include a proteolytically cleavable linker interposed between the nucleotide sequence encoding the first polypeptide and the nucleotide sequence encoding the second polypeptide. In some cases, the nucleotide sequences encoding the first polypeptide and the second polypeptide of a multimeric polypeptide of the present disclosure includes an internal ribosome entry site (IRES) interposed between the nucleotide sequence encoding the first polypeptide and the nucleotide sequence encoding the second polypeptide. In some cases, the nucleotide sequences encoding the first polypeptide and the second polypeptide of a multimeric polypeptide of the present disclosure includes a ribosome skipping signal (or cis-acting hydrolase element, CHYSEL) interposed between the nucleotide sequence encoding the first polypeptide and the nucleotide sequence encoding the second polypeptide. Examples of nucleic acids are described below, where a proteolytically cleavable linker is provided between nucleotide sequences encoding the first polypeptide and the second polypeptide of a multimeric polypeptide of the present disclosure; in any of these embodiments, an IRES or a ribosome skipping signal can be used in place of the nucleotide sequence encoding the proteolytically cleavable linker.

In some cases, a first nucleic acid (e.g., a recombinant expression vector, an mRNA, a viral RNA, etc.) comprises a nucleotide sequence encoding a first polypeptide chain of a multimeric polypeptide of the present disclosure; and a second nucleic acid (e.g., a recombinant expression vector, an mRNA, a viral RNA, etc.) comprises a nucleotide sequence encoding a second polypeptide chain of a multimeric polypeptide of the present disclosure. In some cases, the nucleotide sequence encoding the first polypeptide, and the second nucleotide sequence encoding the second polypeptide, are each operably linked to transcriptional control elements, e.g., promoters, such as promoters that are functional in a eukaryotic cell, where the promoter can be a constitutive promoter or an inducible promoter.

The present disclosure provides a nucleic acid comprising a nucleotide sequence encoding a recombinant polypeptide, where the recombinant polypeptide comprises, in order from N-terminus to C-terminus: a) an epitope (e.g., a T-cell epitope); b) a first MHC polypeptide; c) an immunomodulatory polypeptide (e.g., a reduced-affinity variant as described above); d) a proteolytically cleavable linker; e) a second MHC polypeptide; and f) an immunoglobulin (Ig) Fc polypeptide. The present disclosure provides a nucleic acid comprising a nucleotide sequence encoding a recombinant polypeptide, where the recombinant polypeptide comprises, in order from N-terminus to C-terminus: a) a first leader peptide; b) the epitope; c) the first MHC polypeptide; d) the immunomodulatory polypeptide (e.g., a reduced-affinity variant as described above); e) the proteolytically cleavable linker; f) a second leader peptide; g) the second MHC polypeptide; and h) the Ig Fc polypeptide. The present disclosure provides a nucleic acid comprising a nucleotide sequence encoding a recombinant polypeptide, where the recombinant polypeptide comprises, in order from N-terminus to C-terminus: a) an epitope; b) a first MHC polypeptide; c) a proteolytically cleavable linker; d) an immunomodulatory polypeptide (e.g., a reduced-affinity variant as described above); e) a second MHC polypeptide; and f) an Ig Fc polypeptide. In some cases, the first leader peptide and the second leader peptide is a β2-M leader peptide. In some cases, the nucleotide sequence is operably linked to a transcriptional control element. In some cases, the transcriptional control element is a promoter that is functional in a eukaryotic cell.

Suitable MHC polypeptides are described above. In some cases, the first MHC polypeptide is a β2-microglobulin polypeptide; and wherein the second MHC polypeptide is an MHC class I heavy chain polypeptide. In some cases, the β2-microglobulin polypeptide comprises an amino acid sequence having at least 85% amino acid sequence identity to a β2M amino acid sequence depicted in FIG. 7. In some cases, the MHC class I heavy chain polypeptide is an HLA-A, HLA-B, HLA-C, HLA-E, HLA-F, HLA-G, HLA-K, or HLA-L heavy chain. In some cases, the MHC class I heavy chain polypeptide comprises an amino acid sequence having at least 85% amino acid sequence identity to the amino acid sequence depicted in any one of FIG. 6A-6C. In some cases, the first MHC polypeptide is an MHC Class II alpha chain polypeptide; and wherein the second MHC polypeptide is an MHC class II beta chain polypeptide.

Suitable Fc polypeptides are described above. In some cases, the Ig Fc polypeptide is an IgG1 Fc polypeptide, an IgG2 Fc polypeptide, an IgG3 Fc polypeptide, an IgG4 Fc polypeptide, an IgA Fc polypeptide, or an IgM Fc polypeptide. In some cases, the Ig Fc polypeptide comprises an amino acid sequence having at least 85% amino acid sequence identity to an amino acid sequence depicted in FIG. 5A-5G.

Suitable immunomodulatory polypeptides are described above.

Suitable proteolytically cleavable linkers are described above. In some cases, the proteolytically cleavable linker comprises an amino acid sequence selected from: a) LEVLFQGP (SEQ ID NO:44); b) ENLYTQS (SEQ ID NO:45); c) DDDDK (SEQ ID NO:46); d) LVPR (SEQ ID NO:47); and e) GSGATNFSLLKQAGDVEENPGP (SEQ ID NO:48).

In some cases, a linker between the epitope and the first MHC polypeptide comprises a first Cys residue, and the second MHC polypeptide comprises an amino acid substitution to provide a second Cys residue, such that the first and the second Cys residues provide for a disulfide linkage between the linker and the second MHC polypeptide. In some cases, first MHC polypeptide comprises an amino acid substitution to provide a first Cys residue, and the second MHC polypeptide comprises an amino acid substitution to provide a second Cys residue, such that the first Cys residue and the second Cys residue provide for a disulfide linkage between the first MHC polypeptide and the second MHC polypeptide.

Recombinant Expression Vectors

The present disclosure provides recombinant expression vectors comprising nucleic acids of the present disclosure. In some cases, the recombinant expression vector is a non-viral vector. In some embodiments, the recombinant expression vector is a viral construct, e.g., a recombinant adeno-associated virus construct (see, e.g., U.S. Pat. No. 7,078,387), a recombinant adenoviral construct, a recombinant lentiviral construct, a recombinant retroviral construct, a non-integrating viral vector, etc.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like.

Numerous suitable expression vectors are known to those of skill in the art, and many are commercially available. The following vectors are provided by way of example; for eukaryotic host cells: pXT1, pSG5 (Stratagene), pSVK3, pBPV, pMSG, and pSVLSV40 (Pharmacia). However, any other vector may be used so long as it is compatible with the host cell.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology*, 153:516-544).

In some embodiments, a nucleotide sequence encoding a DNA-targeting RNA and/or a site-directed modifying polypeptide is operably linked to a control element, e.g., a transcriptional control element, such as a promoter. The transcriptional control element may be functional in either a eukaryotic cell, e.g., a mammalian cell; or a prokaryotic cell (e.g., bacterial or archaeal cell). In some embodiments, a nucleotide sequence encoding a DNA-targeting RNA and/or a site-directed modifying polypeptide is operably linked to multiple control elements that allow expression of the nucleotide sequence encoding a DNA-targeting RNA and/or a site-directed modifying polypeptide in both prokaryotic and eukaryotic cells.

Non-limiting examples of suitable eukaryotic promoters (promoters functional in a eukaryotic cell) include those from cytomegalovirus (CMV) immediate early, herpes simplex virus (HSV) thymidine kinase, early and late SV40, long terminal repeats (LTRs) from retrovirus, and mouse metallothionein-I. Selection of the appropriate vector and promoter is well within the level of ordinary skill in the art. The expression vector may also contain a ribosome binding site for translation initiation and a transcription terminator. The expression vector may also include appropriate sequences for amplifying expression.

Genetically Modified Host Cells

The present disclosure provides a genetically modified host cell, where the host cell is genetically modified with a nucleic acid of the present disclosure.

Suitable host cells include eukaryotic cells, such as yeast cells, insect cells, and mammalian cells. In some cases, the host cell is a cell of a mammalian cell line. Suitable mammalian cell lines include human cell lines, non-human primate cell lines, rodent (e.g., mouse, rat) cell lines, and the like. Suitable mammalian cell lines include, but are not limited to, HeLa cells (e.g., American Type Culture Collection (ATCC) No. CCL-2), CHO cells (e.g., ATCC Nos. CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, and the like.

In some cases, the host cell is a mammalian cell that has been genetically modified such that it does not synthesize endogenous MHC β2-M.

In some cases, the host cell is a mammalian cell that has been genetically modified such that it does not synthesize endogenous MHC Class I heavy chain.

Compositions

The present disclosure provides compositions, including pharmaceutical compositions, comprising a T-cell modulatory multimeric polypeptide (synTac) of the present disclosure. The present disclosure provides compositions, including pharmaceutical compositions, comprising a multimeric polypeptide of the present disclosure. The present disclosure provides compositions, including pharmaceutical compositions, comprising a nucleic acid or a recombinant expression vector of the present disclosure.

Compositions Comprising A Multimeric Polypeptide

A composition of the present disclosure can comprise, in addition to a multimeric polypeptide of the present disclosure, one or more of: a salt, e.g., NaCl, $MgCl_2$, KCl, $MgSO_4$, etc.; a buffering agent, e.g., a Tris buffer, N-(2-Hydroxyethyl)piperazine-N'-(2-ethanesulfonic acid) (HEPES), 2-(N-Morpholino)ethanesulfonic acid (MES), 2-(N-Morpholino) ethanesulfonic acid sodium salt (MES), 3-(N-Morpholino) propanesulfonic acid (MOPS), N-tris[Hydroxymethyl] methyl-3-aminopropanesulfonic acid (TAPS), etc.; a solubilizing agent; a detergent, e.g., a non-ionic detergent such as Tween-20, etc.; a protease inhibitor; glycerol; and the like.

The composition may comprise a pharmaceutically acceptable excipient, a variety of which are known in the art and need not be discussed in detail herein. Pharmaceutically acceptable excipients have been amply described in a variety of publications, including, for example, "Remington: The Science and Practice of Pharmacy", $19^{th}$ Ed. (1995), or latest edition, Mack Publishing Co; A. Gennaro (2000) "Remington: The Science and Practice of Pharmacy", 20th edition, Lippincott, Williams, & Wilkins; Pharmaceutical Dosage Forms and Drug Delivery Systems (1999) H. C. Ansel et al., eds $7^{th}$ ed., Lippincott, Williams, & Wilkins; and Handbook of Pharmaceutical Excipients (2000) A. H. Kibbe et al., eds., $3^{rd}$ ed. Amer. Pharmaceutical Assoc.

A pharmaceutical composition can comprise a multimeric polypeptide of the present disclosure, and a pharmaceutically acceptable excipient. In some cases, a subject pharmaceutical composition will be suitable for administration to a subject, e.g., will be sterile. For example, in some embodiments, a subject pharmaceutical composition will be suitable for administration to a human subject, e.g., where the composition is sterile and is free of detectable pyrogens and/or other toxins.

The protein compositions may comprise other components, such as pharmaceutical grades of mannitol, lactose, starch, magnesium stearate, sodium saccharin, talcum, cellulose, glucose, sucrose, magnesium, carbonate, and the like. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate, hydrochloride, sulfate salts, solvates (e.g., nixed ionic salts, water, organics), hydrates (e.g., water), and the like.

For example, compositions may include aqueous solution, powder form, granules, tablets, pills, suppositories, capsules, suspensions, sprays, and the like. The composition may be formulated according to the various routes of administration described below.

Where a multimeric polypeptide of the present disclosure is administered as an injectable (e.g. subcutaneously, intraperitoneally, intramuscularly, and/or intravenously) directly into a tissue, a formulation can be provided as a ready-to-use dosage form, or as non-aqueous form (e.g. a reconstitutable storage-stable powder) or aqueous form, such as liquid composed of pharmaceutically acceptable carriers and excipients. The protein-containing formulations may also be provided so as to enhance serum half-life of the subject protein following administration. For example, the protein may be provided in a liposome formulation, prepared as a colloid, or other conventional techniques for extending serum half-life. A variety of methods are available for preparing liposomes, as described in, e.g., Szoka et al. 1980 Ann. Rev. Biophys. Bioeng. 9:467, U.S. Pat. Nos. 4,235,871, 4,501,728 and 4,837,028. The preparations may also be provided in controlled release or slow-release forms.

Other examples of formulations suitable for parenteral administration include isotonic sterile injection solutions, anti-oxidants, bacteriostats, and solutes that render the formulation isotonic with the blood of the intended recipient, suspending agents, solubilizers, thickening agents, stabilizers, and preservatives. For example, a subject pharmaceutical composition can be present in a container, e.g., a sterile container, such as a syringe. The formulations can be presented in unit-dose or multi-dose sealed containers, such as ampules and vials, and can be stored in a freeze-dried (lyophilized) condition requiring only the addition of the sterile liquid excipient, for example, water, for injections, immediately prior to use. Extemporaneous injection solutions and suspensions can be prepared from sterile powders, granules, and tablets.

The concentration of a multimeric polypeptide of the present disclosure in a formulation can vary widely (e.g., from less than about 0.1%, usually at or at least about 2% to as much as 20% to 50% or more by weight) and will usually be selected primarily based on fluid volumes, viscosities, and patient-based factors in accordance with the particular mode of administration selected and the patient's needs.

The present disclosure provides a container comprising a composition of the present disclosure, e.g., a liquid composition. The container can be, e.g., a syringe, an ampoule, and the like. In some cases, the container is sterile. In some cases, both the container and the composition are sterile.

The present disclosure provides compositions, including pharmaceutical compositions, comprising a T-cell modulatory multimeric polypeptide of the present disclosure. A composition can comprise: a) a T-cell modulatory multimeric polypeptide of the present disclosure; and b) an excipient, as described above for the multimeric polypeptides. In some cases, the excipient is a pharmaceutically acceptable excipient.

In some cases, a T-cell multimeric polypeptide of the present disclosure is present in a liquid composition. Thus, the present disclosure provides compositions (e.g., liquid compositions, including pharmaceutical compositions) comprising a T-cell multimeric polypeptide of the present disclosure. In some cases, a composition of the present disclosure comprises: a) a T-cell multimeric polypeptide of the present disclosure; and b) saline (e.g., 0.9% NaCl). In some cases, the composition is sterile. In some cases, the composition is suitable for administration to a human subject, e.g., where the composition is sterile and is free of detectable pyrogens and/or other toxins. Thus, the present disclosure provides a composition comprising: a) a T-cell multimeric polypeptide of the present disclosure; and b) saline (e.g., 0.9% NaCl), where the composition is sterile and is free of detectable pyrogens and/or other toxins.

Compositions Comprising A Nucleic Acid or A Recombinant Expression Vector

The present disclosure provides compositions, e.g., pharmaceutical compositions, comprising a nucleic acid or a recombinant expression vector of the present disclosure. A wide variety of pharmaceutically acceptable excipients is known in the art and need not be discussed in detail herein. Pharmaceutically acceptable excipients have been amply described in a variety of publications, including, for example, A. Gennaro (2000) "Remington: The Science and Practice of Pharmacy", 20th edition, Lippincott, Williams, & Wilkins; Pharmaceutical Dosage Forms and Drug Delivery Systems (1999) H. C. Ansel et al., eds $7^{th}$ ed., Lippincott, Williams, & Wilkins; and Handbook of Pharmaceutical Excipients (2000) A. H. Kibbe et al., eds., $3^{rd}$ ed. Amer. Pharmaceutical Assoc.

A composition of the present disclosure can include: a) one or more nucleic acids or one or more recombinant expression vectors comprising nucleotide sequences encoding a T-cell modulatory multimeric polypeptide; and b) one or more of: a buffer, a surfactant, an antioxidant, a hydrophilic polymer, a dextrin, a chelating agent, a suspending agent, a solubilizer, a thickening agent, a stabilizer, a bacteriostatic agent, a wetting agent, and a preservative. Suitable buffers include, but are not limited to, (such as N,N-bis(2-hydroxyethyl)-2-aminoethanesulfonic acid (BES), bis(2-hydroxyethyl)amino-tris(hydroxymethyl)methane (BIS-Tris), N-(2-hydroxyethyl)piperazine-N'3-propanesulfonic acid (EPPS or HEPPS), glycylglycine, N-2-hydroxyehtylpiperazine-N'-2-ethanesulfonic acid (HEPES), 3-(N-morpholino)propane sulfonic acid (MOPS), piperazine-N,N'-bis(2-ethane-sulfonic acid) (PIPES), sodium bicarbonate, 3-(N-tris(hydroxymethyl)-methyl-amino)-2-hydroxy-propanesulfonic acid) TAPSO, (N-tris(hydroxymethyl)methyl-2-aminoethanesulfonic acid (TES), N-tris(hydroxymethyl)methyl-glycine (Tricine), tris (hydroxymethyl)-aminomethane (Tris), etc.). Suitable salts include, e.g., NaCl, $MgCl_2$, KCl, $MgSO_4$, etc.

A pharmaceutical formulation of the present disclosure can include a nucleic acid or recombinant expression vector of the present disclosure in an amount of from about 0.001% to about 90% (w/w). In the description of formulations, below, "subject nucleic acid or recombinant expression vector" will be understood to include a nucleic acid or recombinant expression vector of the present disclosure. For example, in some embodiments, a subject formulation comprises a nucleic acid or recombinant expression vector of the present disclosure.

A subject nucleic acid or recombinant expression vector can be admixed, encapsulated, conjugated or otherwise associated with other compounds or mixtures of compounds; such compounds can include, e.g., liposomes or receptor-targeted molecules. A subject nucleic acid or recombinant expression vector can be combined in a formulation with one or more components that assist in uptake, distribution and/or absorption.

A subject nucleic acid or recombinant expression vector composition can be formulated into any of many possible dosage forms such as, but not limited to, tablets, capsules, gel capsules, liquid syrups, soft gels, suppositories, and enemas. A subject nucleic acid or recombinant expression vector composition can also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

A formulation comprising a subject nucleic acid or recombinant expression vector can be a liposomal formulation. As used herein, the term "liposome" means a vesicle composed of amphiphilic lipids arranged in a spherical bilayer or bilayers. Liposomes are unilamellar or multilamellar vesicles which have a membrane formed from a lipophilic material and an aqueous interior that contains the composition to be delivered. Cationic liposomes are positively charged liposomes that can interact with negatively charged DNA molecules to form a stable complex. Liposomes that are pH sensitive or negatively charged are believed to entrap DNA rather than complex with it. Both cationic and non-cationic liposomes can be used to deliver a subject nucleic acid or recombinant expression vector.

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome comprises one or more glycolipids or is derivatized with one or more hydrophilic polymers, such as a polyethylene glycol (PEG)

moiety. Liposomes and their uses are further described in U.S. Pat. No. 6,287,860, which is incorporated herein by reference in its entirety.

The formulations and compositions of the present disclosure may also include surfactants. The use of surfactants in drug products, formulations and in emulsions is well known in the art. Surfactants and their uses are further described in U.S. Pat. No. 6,287,860.

In one embodiment, various penetration enhancers are included, to effect the efficient delivery of nucleic acids. In addition to aiding the diffusion of non-lipophilic drugs across cell membranes, penetration enhancers also enhance the permeability of lipophilic drugs. Penetration enhancers may be classified as belonging to one of five broad categories, i.e., surfactants, fatty acids, bile salts, chelating agents, and non-chelating non-surfactants. Penetration enhancers and their uses are further described in U.S. Pat. No. 6,287,860, which is incorporated herein by reference in its entirety.

Compositions and formulations for oral administration include powders or granules, microparticulates, nanoparticulates, suspensions or solutions in water or non-aqueous media, capsules, gel capsules, sachets, tablets, or minitablets. Thickeners, flavoring agents, diluents, emulsifiers, dispersing aids or binders may be desirable. Suitable oral formulations include those in which a subject antisense nucleic acid is administered in conjunction with one or more penetration enhancers surfactants and chelators. Suitable surfactants include, but are not limited to, fatty acids and/or esters or salts thereof, bile acids and/or salts thereof. Suitable bile acids/salts and fatty acids and their uses are further described in U.S. Pat. No. 6,287,860. Also suitable are combinations of penetration enhancers, for example, fatty acids/salts in combination with bile acids/salts. An exemplary suitable combination is the sodium salt of lauric acid, capric acid, and UDCA. Further penetration enhancers include, but are not limited to, polyoxyethylene-9-lauryl ether, and polyoxyethylene-20-cetyl ether. Suitable penetration enhancers also include propylene glycol, dimethylsulfoxide, triethanoiamine, N,N-dimethylacetamide, N,N-dimethylformamide, 2-pyrrolidone and derivatives thereof, tetrahydrofurfuryl alcohol, and AZONE™.

Methods of Modulating T Cell Activity

The present disclosure provides a method of selectively modulating the activity of an epitope-specific T cell, the method comprising contacting the T cell with a multimeric polypeptide of the present disclosure, where contacting the T cell with a multimeric polypeptide of the present disclosure selectively modulates the activity of the epitope-specific T cell. In some cases, the contacting occurs in vitro. In some cases, the contacting occurs in vivo. In some cases, the contacting occurs ex vivo.

In some cases, e.g., where the target T cell is a $CD8^+$ T cell, the multimeric polypeptide comprises Class I MHC polypeptides (e.g., $\beta$2-microglobulin and Class I MHC heavy chain). In some cases, e.g., where the target T cell is a $CD4^+$ T cell, the multimeric polypeptide comprises Class II MHC polypeptides (e.g., Class II MHC $\alpha$ chain; Class II MHC $\beta$ chain).

Where a multimeric polypeptide of the present disclosure includes an immunomodulatory polypeptide that is an activating polypeptide, contacting the T cell with the multimeric polypeptide activates the epitope-specific T cell. In some instances, the epitope-specific T cell is a T cell that is specific for an epitope present on a cancer cell, and contacting the epitope-specific T cell with the multimeric polypeptide increases cytotoxic activity of the T cell toward the cancer cell. In some instances, the epitope-specific T cell is a T cell that is specific for an epitope present on a cancer cell, and contacting the epitope-specific T cell with the multimeric polypeptide increases the number of the epitope-specific T cells.

In some instances, the epitope-specific T cell is a T cell that is specific for an epitope present on a virus-infected cell, and contacting the epitope-specific T cell with the multimeric polypeptide increases cytotoxic activity of the T cell toward the virus-infected cell. In some instances, the epitope-specific T cell is a T cell that is specific for an epitope present on a virus-infected cell, and contacting the epitope-specific T cell with the multimeric polypeptide increases the number of the epitope-specific T cells.

Where a multimeric polypeptide of the present disclosure includes an immunomodulatory polypeptide that is an inhibiting polypeptide, contacting the T cell with the multimeric inhibits the epitope-specific T cell. In some instances, the epitope-specific T cell is a self-reactive T cell that is specific for an epitope present in a self antigen, and the contacting reduces the number of the self-reactive T cells.

Methods of Selectively Delivering a Costimulatory Polypeptide

The present disclosure provides a method of delivering a costimulatory polypeptide, or a reduced-affinity variant of a naturally occurring costimulatory (i.e., immunomodulatory) polypeptide (such as variant immunodulatory polypeptide disclosed herein), to a selected T cell or a selected T cell population, e.g., in a manner such that a TCR specific for a given epitope is targeted. The present disclosure provides a method of delivering a costimulatory polypeptide, or a reduced-affinity variant of a naturally occurring costimulatory polypeptide (such as variant immunodulatory polypeptide disclosed herein), selectively to a target T cell hearing a TCR specific for the epitope present in a multimeric polypeptide of the present disclosure. The method comprises contacting a population of T cells with a multimeric polypeptide of the present disclosure. The population of T cells can be a mixed population that comprises: i) the target T cell; and ii) non-target T cells that are not specific for the epitope (e.g., T cells that are specific for an epitope(s) other than the epitope to which the epitope-specific T cell binds). The epitope-specific T cell is specific for the epitope-presenting peptide present in the multimeric polypeptide, and binds to the peptide HLA complex or peptide MHC complex provided by the multimeric polypeptide. Contacting the population of T cells with the multimeric polypeptide delivers the costimulatory polypeptide (e.g., a wild-type immunomodulatory polypeptide or a reduced-affinity variant of the wild-type immunomodulatory polypeptide, as described herein) present in the multimeric polypeptide selectively to the T cell(s) that are specific for the epitope present in the multimeric polypeptide.

Thus, the present disclosure provides a method of delivering a costimulatory (immunomodulatory) polypeptide, or a reduced-affinity variant of a naturally occurring costimulatory (immunomodulatory) polypeptide (such as variant immunodulatory polypeptide disclosed herein), or a combination of both, selectively to a target T cell, the method comprising contacting a mixed population of T cells with a multimeric polypeptide of the present disclosure. The mixed population of T cells comprises the target T cell and non-target T cells. The target T cell is specific for the epitope present within the multimeric polypeptide. Contacting the mixed population of T cells with a multimeric polypeptide of the present disclosure delivers the costimulatory polypeptide(s) present within the multimeric polypeptide to the target T cell.

For example, a multimeric polypeptide of the present disclosure is contacted with a population of T cells comprising: i) a target T cell(s) that is specific for the epitope present in the multimeric polypeptide; and ii) a non-target T cell(s), e.g., a T cell(s) that is specific for a second epitope(s) that is not the epitope present in the multimeric polypeptide. Contacting the population results in selective delivery of the costimulatory polypeptide(s) (e.g., naturally-occurring costimulatory polypeptide (e.g., naturally occurring IL-2) or reduced-affinity variant of a naturally occurring costimulatory polypeptide (e.g., an IL-2 variant disclosed herein)), which is present in the multimeric polypeptide, to the target T cell. Thus, e.g., less than 50%, less than 40%, less than 30%, less than 25%, less than 20%, less than 15%, less than 10%, less than 5%, or less than 4%, 3%, 2% or 1%, of the non-target T cells bind the multimeric polypeptide and, as a result, the costimulatory polypeptide (e.g., IL-2 or IL-2 variant) is not delivered to the non-target T cells. As another example, contacting the population results in selective delivery of the costimulatory polypeptide(s) (e.g., naturally-occurring costimulatory polypeptide (e.g., naturally occurring 4-1BBL) or reduced-affinity variant of a naturally occurring costimulatory polypeptide (e.g., a 4-1BBL variant disclosed herein)), which is present in the multimeric polypeptide, to the target T cell. Thus, e.g., less than 50%, less than 40%, less than 30%, less than 25%, less than 20%, less than 15%, less than 10%, less than 5%, or less than 4%, 3%, 2% or 1%, of the non-target T cells bind the multimeric polypeptide and, as a result, the costimulatory polypeptide (e.g., 4-1BBL or 4-1BBL variant) is not delivered to the non-target T cells.

In some cases, the population of T cells is in vitro. In some cases, the population of T cells is in vitro, and a biological response (e.g., T cell activation and/or expansion and/or phenotypic differentiation) of the target T cell population to the multimeric polypeptide of the present disclosure is elicited in the context of an in vitro culture. For example, a mixed population of T cells can be obtained from an individual, and can be contacted with the multimeric polypeptide in vitro. Such contacting can comprise single or multiple exposures of the population of T cells to a defined dose(s) and/or exposure schedule(s). In some cases, said contacting results in selectively binding/activating and/or expanding target T cells within the population of T cells, and results in generation of a population of activated and/or expanded target T cells. As an example, a mixed population of T cells can be peripheral blood mononuclear cells (PBMC). For example, PBMC from a patient can be obtained by standard blood drawing and PBMC enrichment techniques before being exposed to 0.1-1000 nM of a multimeric polypeptide of the present disclosure under standard lymphocyte culture conditions. At time points before, during, and after exposure of the mixed T cell population at a defined dose and schedule, the abundance of target T cells in the in vitro culture can be monitored by specific peptide-MHC multimers and/or phenotypic markers and/or functional activity (e.g. cytokine ELISpot assays). In some cases, upon achieving an optimal abundance and/or phenotype of antigen specific cells in vitro, all or a portion of the population of activated and/or expanded target T cells is administered to the individual (the individual from whom the mixed population of T cells was obtained).

In some cases, the population of T cells is in vitro. For example, a mixed population of T cells is obtained from an individual, and is contacted with a multimeric polypeptide of the present disclosure in vitro. Such contacting, which can comprise single or multiple exposures of the T cells to a defined dose(s) and/or exposure schedule(s) in the context of in vitro cell culture, can be used to determine whether the mixed population of T cells includes T cells that are specific for the epitope presented by the multimeric polypeptide. The presence of T cells that are specific for the epitope of the multimeric polypeptide can be determined by assaying a sample comprising a mixed population of T cells, which population of T cells comprises T cells that are not specific for the epitope (non-target T cells) and may comprise T cells that are specific for the epitope (target T cells). Known assays can be used to detect activation and/or proliferation of the target T cells, thereby providing an ex vivo assay that can determine whether a particular multimeric polypeptide (synTac) possesses an epitope that binds to T cells present in the individual and thus whether the multimeric polypeptide has potential use as a therapeutic composition for that individual. Suitable known assays for detection of activation and/or proliferation of target T cells include, e.g., flow cytometric characterization of T cell phenotype and/or antigen specificity and/or proliferation. Such an assay to detect the presence of epitope-specific T cells, e.g., a companion diagnostic, can further include additional assays (e.g. effector cytokine ELISpot assays) and/or appropriate controls (e.g. antigen-specific and antigen-nonspecific multimeric peptide-HLA staining reagents) to determine whether the multimeric polypeptide is selectively binding/activating and/or expanding the target T cell. Thus, for example, the present disclosure provides a method of detecting, in a mixed population of T cells obtained from an individual, the presence of a target T cell that binds an epitope of interest, the method comprising: a) contacting in vitro the mixed population of T cells with a multimeric polypeptide of the present disclosure, wherein the multimeric polypeptide comprises the epitope of interest; and b) detecting activation and/or proliferation of T cells in response to said contacting, wherein activated and/or proliferated T cells indicates the presence of the target T cell. Alternatively, and/or in addition, if activation and/or expansion (proliferation) of the desired T cell population is obtained using the multimeric polypeptide, then all or a portion of the population of T cells comprising the activated/expanded T cells can be administered hack to the individual as a therapy.

In some instances, the population of T cells is in vivo in an individual. In such instances, a method of the present disclosure for selectively delivering a costimulatory polypeptide (e.g., IL-2 or a reduced-affinity IL-2; 4-1BBL or a reduced affinity 4-1BBL; PD-L1 or a reduced affinity PD-L1; CD80 or a reduced affinity CD80; or CD86 or a reduced affinity CD86) to an epitope-specific T cell comprises administering the multimeric polypeptide to the individual.

The epitope-specific T cell to which a costimulatory polypeptide (e.g., IL-2 or a reduced-affinity TL-2; 4-1BBL or a reduced affinity 4-1BBL; PD-L1 or a reduced affinity PD-L1; CD80 or a reduced affinity CD80; or CD86 or a reduced affinity CD86) is being selectively delivered is also referred to herein as a "target T cell." In some cases, the target T cell is a regulatory T cell (Treg). In some cases, the Treg inhibits or suppresses activity of an autoreactive T cell. In some cases, the target T cell is a cytotoxic T cell. For example, the target T cell can be a cytotoxic T cell specific for a cancer epitope (e.g., an epitope presented by a cancer cell).

Treatment Methods

The present disclosure provides a method of treatment of an individual, the method comprising administering to the individual an amount of a T-cell modulatory multimeric polypeptide of the present disclosure, or one or more nucleic acids encoding the T-cell modulatory multimeric polypeptide, effective to treat the individual. Also provided is a T-cell modulatory multimeric polypeptide of the present disclosure for use in a method of treatment of the human or animal body. In some cases, a treatment method of the present disclosure comprises administering to an individual in need thereof one or more recombinant expression vectors comprising nucleotide sequences encoding a multimeric polypeptide of the present disclosure. In some cases, a treatment method of the present disclosure comprises administering to an individual in need thereof one or more mRNA molecules comprising nucleotide sequences encoding a T-cell modulatory multimeric polypeptide of the present disclosure. In some cases, a treatment method of the present disclosure comprises administering to an individual in need thereof a T-cell modulatory multimeric polypeptide of the present disclosure. Conditions that can be treated include, e.g., cancer and autoimmune disorders, as described below.

In some cases, a T-cell modulatory multimeric polypeptide of the present disclosure, when administered to an individual in need thereof, induces both an epitope-specific T cell response and an epitope non-specific T cell response. In other words, in some cases, a T-cell modulatory multimeric polypeptide of the present disclosure, when administered to an individual in need thereof, induces an epitope-specific T cell response by modulating the activity of a first T cell that displays both: i) a TCR specific for the epitope present in the T-cell modulatory multimeric polypeptide; ii) a co-immunomodulatory polypeptide that binds to the immunomodulatory polypeptide present in the T-cell modulatory multimeric polypeptide; and induces an epitope non-specific T cell response by modulating the activity of a second T cell that displays: i) a TCR specific for an epitope other than the epitope present in the T-cell modulatory multimeric polypeptide; and ii) a co-immunomodulatory polypeptide that hinds to the immunomodulatory polypeptide present in the T-cell modulatory multimeric polypeptide. The ratio of the epitope-specific T cell response to the epitope-non-specific T cell response is at least 2:1, at least 5:1, at least 10:1, at least 15:1, at least 20:1, at least 25:1, at least 50:1, or at least 100:1. The ratio of the epitope-specific T cell response to the epitope-non-specific T cell response is from about 2:1 to about 5:1, from about 5:1 to about 10:1, from about 10:1 to about 15:1, from about 15:1 to about 20:1, from about 20:1 to about 25:1, from about 25:1 to about 50:1, or from about 50:1 to about 100:1, or more than 100:1. "Modulating the activity" of a T cell can include one or more of: i) activating a cytotoxic (e.g., CD8$^+$) T cell; ii) inducing cytotoxic activity of a cytotoxic (e.g., CD8$^+$) T cell; iii) inducing production and release of a cytotoxin (e.g., a perforin; a granzyme; a granulysin) by a cytotoxic (e.g., CD8$^+$) T cell; iv) inhibiting activity of an autoreactive T cell; and the like.

The combination of the reduced affinity of the immunomodulatory polypeptide for its cognate co-immunomodulatory polypeptide, and the affinity of the epitope for a TCR, provides for enhanced selectivity of a T-cell modulatory multimeric polypeptide of the present disclosure. Thus, for example, a T-cell modulatory multimeric polypeptide of the present disclosure binds with higher avidity to a first T cell that displays both: i) a TCR specific for the epitope present in the T-cell modulatory multimeric polypeptide; and ii) a co-immunomodulatory polypeptide that binds to the immunomodulatory polypeptide present in the T-cell modulatory multimeric polypeptide, compared to the avidity to which it binds to a second T cell that displays: i) a TCR specific for an epitope other than the epitope present in the T-cell modulatory multimeric polypeptide; and ii) a co-immunomodulatory polypeptide that binds to the immunomodulatory polypeptide present in the T-cell modulatory multimeric polypeptide.

The present disclosure provides a method of selectively modulating the activity of an epitope-specific T cell in an individual, the method comprising administering to the individual an effective amount of a multimeric polypeptide of the present disclosure, or one or more nucleic acids (e.g., expression vectors; mRNA; etc.) comprising nucleotide sequences encoding the multimeric polypeptide, where the multimeric polypeptide selectively modulates the activity of the epitope-specific T cell in the individual. Selectively modulating the activity of an epitope-specific T cell can treat a disease or disorder in the individual. Thus, the present disclosure provides a treatment method comprising administering to an individual in need thereof an effective amount of a multimeric polypeptide of the present disclosure.

In some cases, the inmiunomodulatory polypeptide is an activating polypeptide, and the multimeric polypeptide activates the epitope-specific T cell. In some cases, the epitope is a cancer-associated epitope, and the multimeric polypeptide increases the activity of a T cell specific for the cancer-associate epitope.

The present disclosure provides a method of treating cancer in an individual, the method comprising administering to the individual an effective amount of a multimeric polypeptide of the present disclosure, or one or more nucleic acids (e.g., expression vectors; mRNA; etc.) comprising nucleotide sequences encoding the multimeric polypeptide, where the multimeric polypeptide comprises a T-cell epitope that is a cancer epitope, and where the multimeric polypeptide comprises a stimulatory immunomodulatory polypeptide. In some cases, an "effective amount" of a multimeric polypeptide is an amount that, when administered in one or more doses to an individual in need thereof, reduces the number of cancer cells in the individual. For example, in some cases, an "effective amount" of a multimeric polypeptide of the present disclosure is an amount that, when administered in one or more doses to an individual in need thereof, reduces the number of cancer cells in the individual by at least 10%, at least 15%, at least 20%, at least 25%, at least 30%, at least 40%, at least 50%, at least 60%, at least 70%, at least 80%, at least 90%, or at least 95%, compared to the number of cancer cells in the individual before administration of the multimeric polypeptide, or in the absence of administration with the multimeric polypeptide. In some cases, an "effective amount" of a multimeric polypeptide of the present disclosure is an amount that, when administered in one or more doses to an individual in need thereof, reduces the number of cancer cells in the individual to undetectable levels.

In some cases, an "effective amount" of a multimeric polypeptide of the present disclosure is an amount that, when administered in one or more doses to an individual in need thereof, reduces the tumor mass in the individual. For example, in some cases, an "effective amount" of a multimeric polypeptide of the present disclosure is an amount that, when administered in one or more doses to an individual in need thereof (an individual having a tumor), reduces the tumor mass in the individual by at least 10%, at least 15%, at least 20%, at least 25%, at least 30%, at least 40%, at least 50%, at least 60%, at least 70%, at least 80%, at least 90%, or at least 95%, compared to the tumor mass in the individual before administration of the multimeric polypeptide, or in the absence of administration with the multimeric polypeptide. In some cases, an "effective amount" of a multimeric polypeptide of the present disclosure is an amount that, when administered in one or more doses to an individual in need thereof (an individual having a tumor), reduces the tumor volume in the individual. For example, in some cases, an "effective amount" of a multimeric polypeptide of the present disclosure is an amount that, when administered in one or more doses to an individual in need thereof (an individual having a tumor), reduces the tumor volume in the individual by at least 10%, at least 15%, at least 20%, at least 25%, at least 30%, at least 40%, at least 50%, at least 60%, at least 70%, at least 80%, at least 90%, or at least 95%, compared to the tumor volume in the individual before administration of the multimeric polypeptide, or in the absence of administration with the multimeric polypeptide. In some cases, an "effective amount" of a multimeric polypeptide of the present disclosure is an amount that, when administered in one or more doses to an individual in need thereof, increases survival time of the individual. For example, in some cases, an "effective amount" of a multimeric polypeptide of the present disclosure is an amount that, when administered in one or more doses to an individual in need thereof, increases survival time of the individual by at least 1 month, at least 2 months, at least 3 months, from 3 months to 6 months, from 6 months to 1 year, from 1 year to 2 years, from 2 years to 5 years, from 5 years to 10 years, or more than 10 years, compared to the expected survival time of the individual in the absence of administration with the multimeric polypeptide.

In some instances, the epitope-specific T cell is a T cell that is specific for an epitope present on a virus-infected cell, and contacting the epitope-specific T cell with the multimeric polypeptide increases cytotoxic activity of the T cell toward the virus-infected cell. In some instances, the epitope-specific T cell is a T cell that is specific for an epitope present on a virus-infected cell, and contacting the epitope-specific T cell with the multimeric polypeptide increases the number of the epitope-specific T cells.

Thus, the present disclosure provides a method of treating a virus infection in an individual, the method comprising administering to the individual an effective amount of a multimeric polypeptide of the present disclosure, or one or more nucleic acids comprising nucleotide sequences encoding the multimeric polypeptide, where the multimeric polypeptide comprises a T-cell epitope that is a viral epitope, and where the multimeric polypeptide comprises a stimulatory immunomodulatory polypeptide. In some cases, an "effective amount" of a multimeric polypeptide is an amount that, when administered in one or more doses to an individual in need thereof, reduces the number of virus-infected cells in the individual. For example, in some cases, an "effective amount" of a multimeric polypeptide of the present disclosure is an amount that, when administered in one or more doses to an individual in need thereof, reduces the number of virus-infected cells in the individual by at least 10%, at least 15%, at least 20%, at least 25%, at least 30%, at least 40%, at least 50%, at least 60%, at least 70%, at least 80%, at least 90%, or at least 95%, compared to the number of virus-infected cells in the individual before administration of the multimeric polypeptide, or in the absence of administration with the multimeric polypeptide. In some cases, an "effective amount" of a multimeric polypeptide of the present disclosure is an amount that, when administered in one or more doses to an individual in need thereof, reduces the number of virus-infected cells in the individual to undetectable levels.

Thus, the present disclosure provides a method of treating an infection in an individual, the method comprising administering to the individual an effective amount of a T-cell modulatory multimeric polypeptide of the present disclosure, or one or more nucleic acids comprising nucleotide sequences encoding the multimeric polypeptide, where the multimeric polypeptide comprises a T-cell epitope that is a pathogen-associated epitope, and where the multimeric polypeptide comprises a stimulatory immunomodulatory polypeptide. In some cases, an "effective amount" of a T-cell modulatory multimeric polypeptide of the present disclosure is an amount that, when administered in one or more doses to an individual in need thereof, reduces the number of pathogens in the individual. For example, in some cases, an "effective amount" of a T-cell modulatory multimeric polypeptide of the present disclosure is an amount that, when administered in one or more doses to an individual in need thereof, reduces the number of pathogens in the individual by at least 10%, at least 15%, at least 20%, at least 25%, at least 30%, at least 40%, at least 50%, at least 60%, at least 70%, at least 80%, at least 90%, or at least 95%, compared to the number of pathogens in the individual before administration of the multimeric polypeptide, or in the absence of administration with the multimeric polypeptide. In some cases, an "effective amount" of a multimeric polypeptide of the present disclosure is an amount that, when administered in one or more doses to an individual in need thereof, reduces the number of pathogens in the individual to undetectable levels. Pathogens include viruses, bacteria, protozoans, and the like.

In some cases, the immunomodulatory polypeptide is an inhibitory polypeptide, and the multimeric polypeptide inhibits activity of the epitope-specific T cell. In some cases, the epitope is a self-epitope, and the multimeric polypeptide selectively inhibits the activity of a T cell specific for the self-epitope.

The present disclosure provides a method of treating an autoimmune disorder in an individual, the method comprising administering to the individual an effective amount of a multimeric polypeptide of the present disclosure, or one or more nucleic acids comprising nucleotide sequences encoding the multimeric polypeptide, where the multimeric polypeptide comprises a T-cell epitope that is a self epitope, and where the multimeric polypeptide comprises an inhibitory immunomodulatory polypeptide. In some cases, an "effective amount" of a T-cell modulatory multimeric polypeptide of the present disclosure is an amount that, when administered in one or more doses to an individual in need thereof, reduces the number self-reactive T cells by at least 10%, at least 15%, at least 20%, at least 25%, at least 30%, at least 40%, at least 50%, at least 60%, at least 70%, at least 80%, at least 90%, or at least 95%, compared to number of self-reactive T cells in the individual before administration of the multimeric polypeptide, or in the absence of administration with the T-cell modulatory multimeric polypeptide. In some cases, an "effective amount" of a multimeric polypeptide is an amount that, when administered in one or more doses to an individual in need thereof, reduces production of Th2 cytokines in the individual. In some cases, an "effective amount" of a T-cell modulatory multimeric polypeptide of the present disclosure is an amount that, when administered in one or more doses to an individual in need thereof, ameliorates one or more symptoms associated with an autoimmune disease in the individual.

As noted above, in some cases, in carrying out a subject treatment method, a T-cell modulatory multimeric polypeptide of the present disclosure is administered to an individual in need thereof, as the multimeric polypeptide per se. In other instances, in carrying out a subject treatment method, one or more nucleic acids comprising nucleotide sequences encoding a T-cell modulatory multimeric polypeptide of the present disclosure is/are administering to an individual in need thereof. Thus, in other instances, one or more nucleic acids of the present disclosure, e.g., one or more recombinant expression vectors of the present disclosure, is/are administered to an individual in need thereof.

Formulations

Suitable formulations are described above, where suitable formulations include a pharmaceutically acceptable excipient. In some cases, a suitable formulation comprises: a) a T-cell modulatory multimeric polypeptide of the present disclosure; and b) a pharmaceutically acceptable excipient. In some cases, a suitable formulation comprises: a) a nucleic acid comprising a nucleotide sequence encoding a multimeric polypeptide of the present disclosure; and b) a pharmaceutically acceptable excipient; in some instances, the nucleic acid is an mRNA. In some cases, a suitable formulation comprises: a) a first nucleic acid comprising a nucleotide sequence encoding the first polypeptide of a T-cell modulatory multimeric polypeptide of the present disclosure; b) a second nucleic acid comprising a nucleotide sequence encoding the second polypeptide of a multimeric polypeptide of the present disclosure; and c) a pharmaceutically acceptable excipient. In some cases, a suitable formulation comprises: a) a recombinant expression vector comprising a nucleotide sequence encoding a T-cell modulatory multimeric polypeptide of the present disclosure; and b) a pharmaceutically acceptable excipient. In some cases, a suitable formulation comprises: a) a first recombinant expression vector comprising a nucleotide sequence encoding the first polypeptide of a T-cell modulatory multimeric polypeptide of the present disclosure; b) a second recombinant expression vector comprising a nucleotide sequence encoding the second polypeptide of T-cell modulatory multimeric polypeptide of the present disclosure; and c) a pharmaceutically acceptable excipient.

Suitable pharmaceutically acceptable excipients are described above.

Dosages

A suitable dosage can be determined by an attending physician or other qualified medical personnel, based on various clinical factors. As is well known in the medical arts, dosages for any one patient depend upon many factors, including the patient's size, body surface area, age, the particular polypeptide or nucleic acid to be administered, sex of the patient, time, and route of administration, general health, and other drugs being administered concurrently. A multimeric polypeptide of the present disclosure may be administered in amounts between 1 ng/kg body weight and 20 mg/kg body weight per dose, e.g. between 0.1 mg/kg body weight to 10 mg/kg body weight, e.g. between 0.5 mg/kg body weight to 5 mg/kg body weight; however, doses below or above this exemplary range are envisioned, especially considering the aforementioned factors. If the regimen is a continuous infusion, it can also be in the range of 1 μg to 10 mg per kilogram of body weight per minute. A multimeric polypeptide of the present disclosure can be administered in an amount of from about 1 mg/kg body weight to 50 mg/kg body weight, e.g., from about 1 mg/kg body weight to about 5 mg/kg body weight, from about 5 mg/kg body weight to about 10 mg/kg body weight, from about 10 mg/kg body weight to about 15 mg/kg body weight, from about 15 mg/kg body weight to about 20 mg/kg body weight, from about 20 mg/kg body weight to about 25 mg/kg body weight, from about 25 mg/kg body weight to about 30 mg/kg body weight, from about 30 mg/kg body weight to about 35 mg/kg body weight, from about 35 mg/kg body weight to about 40 mg/kg body weight, or from about 40 mg/kg body weight to about 50 mg/kg body weight.

In some cases, a suitable dose of a multimeric polypeptide of the present disclosure is from 0.01 μg to 100 g per kg of body weight, from 0.1 μg to 10 g per kg of body weight, from 1 μg to 1 g per kg of body weight, from 10 μg to 100 mg per kg of body weight, from 100 μg to 10 mg per kg of body weight, or from 100 μg to 1 mg per kg of body weight. Persons of ordinary skill in the art can easily estimate repetition rates for dosing based on measured residence times and concentrations of the administered agent in bodily fluids or tissues. Following successful treatment, it may be desirable to have the patient undergo maintenance therapy to prevent the recurrence of the disease state, wherein a multimeric polypeptide of the present disclosure is administered in maintenance doses, ranging from 0.01 μg to 100 g per kg of body weight, from 0.1 μg to 10 g per kg of body weight, from 1 μg to 1 g per kg of body weight, from 10 μg to 100 mg per kg of body weight, from 100 μg to 10 mg per kg of body weight, or from 100 μg to 1 mg per kg of body weight.

Those of skill will readily appreciate that dose levels can vary as a function of the specific multimeric polypeptide, the severity of the symptoms and the susceptibility of the subject to side effects. Preferred dosages for a given compound are readily determinable by those of skill in the art by a variety of means.

In some embodiments, multiple doses of a multimeric polypeptide of the present disclosure, a nucleic acid of the present disclosure, or a recombinant expression vector of the present disclosure are administered. The frequency of administration of a multimeric polypeptide of the present disclosure, a nucleic acid of the present disclosure, or a recombinant expression vector of the present disclosure can vary depending on any of a variety of factors, e.g., severity of the symptoms, etc. For example, in some embodiments, a multimeric polypeptide of the present disclosure, a nucleic acid of the present disclosure, or a recombinant expression vector of the present disclosure is administered once per month, twice per month, three times per month, every other week (qow), once per week (qw), twice per week (biw), three times per week (tiw), four times per week, five times per week, six times per week, every other day (qod), daily (qd), twice a day (qid), or three times a day (tid).

The duration of administration of a multimeric polypeptide of the present disclosure, a nucleic acid of the present disclosure, or a recombinant expression vector of the present disclosure, e.g., the period of time over which a multimeric polypeptide of the present disclosure, a nucleic acid of the present disclosure, or a recombinant expression vector of the present disclosure is administered, can vary, depending on any of a variety of factors, e.g., patient response, etc. For example, a multimeric polypeptide of the present disclosure, a nucleic acid of the present disclosure, or a recombinant expression vector of the present disclosure can be administered over a period of time ranging from about one day to about one week, from about two weeks to about four weeks, from about one month to about two months, from about two months to about four months, from about four months to about six months, from about six months to about eight months, from about eight months to about 1 year, from about 1 year to about 2 years, or from about 2 years to about 4 years, or more.

Routes of Administration

An active agent (a multimeric polypeptide of the present disclosure, a nucleic acid of the present disclosure, or a recombinant expression vector of the present disclosure) is administered to an individual using any available method and route suitable for drug delivery, including in vivo and ex vivo methods, as well as systemic and localized routes of administration.

Conventional and pharmaceutically acceptable routes of administration include intratumoral, peritumoral, intramuscular, intralymphatic, intratracheal, intracranial. subcutaneous, intradermal, topical application, intravenous, intraarterial, rectal, nasal, oral, and other enteral and parenteral routes of administration. Routes of administration may be combined, if desired, or adjusted depending upon the multimeric polypeptide and/or the desired effect. A multimeric polypeptide of the present disclosure, or a nucleic acid or recombinant expression vector of the present disclosure, can be administered in a single dose or in multiple doses.

In some embodiments, a multimeric polypeptide of the present disclosure, a nucleic acid of the present disclosure, or a recombinant expression vector of the present disclosure is administered intravenously. In some embodiments, a multimeric polypeptide of the present disclosure, a nucleic acid of the present disclosure, or a recombinant expression vector of the present disclosure is administered intramuscularly. In some embodiments, a multimeric polypeptide of the present disclosure, a nucleic acid of the present disclosure, or a recombinant expression vector of the present disclosure is administered intralymphatically. In some embodiments, a multimeric polypeptide of the present disclosure, a nucleic acid of the present disclosure, or a recombinant expression vector of the present disclosure is administered locally. In some embodiments, a multimeric polypeptide of the present disclosure, a nucleic acid of the present disclosure, or a recombinant expression vector of the present disclosure is administered intratumorally. In some embodiments, a multimeric polypeptide of the present disclosure, a nucleic acid of the present disclosure, or a recombinant expression vector of the present disclosure is administered peritumorally. In some embodiments, a multimeric polypeptide of the present disclosure, a nucleic acid of the present disclosure, or a recombinant expression vector of the present disclosure is administered intracranially. In some embodiments, a multimeric polypeptide of the present disclosure, a nucleic acid of the present disclosure, or a recombinant expression vector of the present disclosure is administered subcutaneously.

In some embodiments, a multimeric polypeptide of the present disclosure is administered intravenously. In some embodiments, a multimeric polypeptide of the present disclosure is administered intramuscularly. In some embodiments, a multimeric polypeptide of the present disclosure is administered locally. In some embodiments, a multimeric polypeptide of the present disclosure is administered intratumorally. In some embodiments, a multimeric polypeptide of the present disclosure is administered peritumorally. In some embodiments, a multimeric polypeptide of the present disclosure is administered intracranially. In some embodiments, a multimeric polypeptide is administered subcutaneously. In some embodiments, a multimeric polypeptide of the present disclosure is administered intralymphatically.

A multimeric polypeptide of the present disclosure, a nucleic acid of the present disclosure, or a recombinant expression vector of the present disclosure can be administered to a host using any available conventional methods and routes suitable for delivery of conventional drugs, including systemic or localized routes. In general, routes of administration contemplated for use in a method of the present disclosure include, but are not necessarily limited to, enteral, parenteral, and inhalational routes.

Parenteral routes of administration other than inhalation administration include, but are not necessarily limited to, topical, transdermal, subcutaneous, intramuscular, intraorbital, intracapsular, intraspinal, intrasternal, intratumoral, intralymphatic, peritumoral, and intravenous routes, i.e., any route of administration other than through the alimentary canal. Parenteral administration can be carried to effect systemic or local delivery of a multimeric polypeptide of the present disclosure, a nucleic acid of the present disclosure, or a recombinant expression vector of the present disclosure. Where systemic delivery is desired, administration typically involves invasive or systemically absorbed topical or mucosal administration of pharmaceutical preparations.

Subjects Suitable for Treatment

Subjects suitable for treatment with a method of the present disclosure include individuals who have cancer, including individuals who have been diagnosed as having cancer, individuals who have been treated for cancer but who failed to respond to the treatment, and individuals who have been treated for cancer and who initially responded but subsequently became refractory to the treatment. Subjects suitable for treatment with a method of the present disclosure include individuals who have an infection (e.g., an infection with a pathogen such as a bacterium, a virus, a protozoan, etc.), including individuals who have been diagnosed as having an infection, and individuals who have been treated for an infection but who failed to respond to the treatment. Subjects suitable for treatment with a method of the present disclosure include individuals who have bacterial infection, including individuals who have been diagnosed as having a bacterial infection, and individuals who have been treated for a bacterial infection but who failed to respond to the treatment. Subjects suitable for treatment with a method of the present disclosure include individuals who have a viral infection, including individuals who have been diagnosed as having a viral infection, and individuals who have been treated for a viral infection but who failed to respond to the treatment. Subjects suitable for treatment with a method of the present disclosure include individuals who have an autoimmune disease, including individuals who have been diagnosed as having an autoimmune disease, and individuals who have been treated for a autoimmune disease but who failed to respond to the treatment.

EXAMPLES OF NON-LIMITING ASPECTS OF THE DISCLOSURE

Aspects Set A

Aspects, including embodiments, of the present subject matter described above may be beneficial alone or in combination, with one or more other aspects or embodiments. Without limiting the foregoing description, certain non-limiting aspects of the disclosure numbered 1-140 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspect 1. A T-cell modulatory multimeric polypeptide, wherein the multimeric polypeptide is:

A) a heterodimer comprising: a) a first polypeptide comprising a first major histocompatibility complex (MHC) polypeptide; and b) a second polypeptide comprising a second MHC polypeptide, wherein the first polypeptide or the second polypeptide comprises an epitope; wherein the first polypeptide and/or the second polypeptide comprises one or more immunomodulatory polypeptides that can be the same or different, and wherein at least one of the one or more immunomodulatory polypeptides may be a wild-type immunomodulatory polypeptide or a variant of a wild-type immunomodulatory polypeptide, wherein the variant immunomodulatory polypeptide comprises 1, 2, 3, 4, 5, 6, 7, 8, 9, 10, 11, 12, 13, 14, 15, 16, 17, 18, 19, or 20 amino acid substitutions compared to the amino acid sequence of the corresponding wild-type immunomodulatory polypeptide; and wherein the first polypeptide or the second polypeptide optionally comprises an immunoglobulin (Ig) Fc polypeptide or a non-Ig scaffold; or B) a heterodimer comprising: a) a first polypeptide comprising a first MHC polypeptide; and b) a second polypeptide comprising a second MHC polypeptide, wherein the first polypeptide or the second polypeptide comprises an epitope; wherein the first polypeptide and/or the second polypeptide comprises one or more immunomodulatory polypeptides that can be the same or different, wherein at least one of the one or more immunomodulatory polypeptides is a variant of a wild-type immunomodulatory polypeptide, wherein the variant immunomodulatory polypeptide comprises 1, 2, 3, 4, 5, 6, 7, 8, 9, 10, 11, 12, 13, 14, 15, 16, 17, 18, 19, or 20 amino acid substitutions compared to the amino acid sequence of the corresponding wild-type immunomodulatory polypeptide, wherein at least one of the one or more immunomodulatory domains is a variant immunomodulatory polypeptide that exhibits reduced affinity to a cognate co-immunomodulatory polypeptide compared to the affinity of a corresponding wild-type immunomodulatory polypeptide for the cognate co-immunomodulatory polypeptide, and wherein the epitope binds to a T-cell receptor (TCR) on a T cell with an affinity of at least $10^{-7}$ M, such that: i) the T-cell modulatory multimeric polypeptide binds to a first T cell with an affinity that is at least 25% higher than the affinity with which the T-cell modulatory multimeric polypeptide binds a second T cell, wherein the first T cell expresses on its surface the cognate co-immunomodulatory polypeptide and a TCR that binds the epitope with an affinity of at least $10^{-7}$ M, and wherein the second T cell expresses on its surface the cognate co-immunomodulatory polypeptide but does not express on its surface a TCR that binds the epitope with an affinity of at least $10^{-7}$ M; and/or ii) the ratio of the binding affinity of a control T-cell modulatory multimeric polypeptide, wherein the control comprises a wild-type immunomodulatory polypeptide, to a cognate co-immunomodulatory polypeptide to the binding affinity of the T-cell modulatory multimeric polypeptide comprising a variant of the wild-type immunomodulatory polypeptide to the cognate co-immunomodulatory polypeptide, when measured by bio-layer interferometry, is in a range of from 1.5:1 to $10^6$:1; and wherein the variant immunomodulatory polypeptide comprises 1, 2, 3, 4, 5, 6, 7, 8, 9, 10, 11, 12, 13, 14, 15, 16, 17, 18, 19, or 20 amino acid substitutions compared to the amino acid sequence of the corresponding wild-type immunomodulatory polypeptide; and wherein the first polypeptide or the second polypeptide optionally comprises an Ig Fc polypeptide or a non-Ig scaffold; or C) a heterodimer comprising: a) a first polypeptide comprising, in order from N-terminus to C-terminus: i) an epitope; ii) a first major histocompatibility complex (MHC) polypeptide; and b) a second polypeptide comprising, in order from N-terminus to C-terminus: i) a second MHC polypeptide; and ii) optionally an immunoglobulin (Ig) Fc polypeptide or a non-Ig scaffold, wherein the multimeric polypeptide comprises one or more immunomodulatory domains that can be the same or different, wherein at least one of the one or more immunomodulatory domain is: A) at the C-terminus of the first polypeptide; B) at the N-terminus of the second polypeptide; C) at the C-terminus of the second polypeptide; or D) at the C-terminus of the first polypeptide and at the N-terminus of the second polypeptide, and wherein at least one of the one or more immunomodulatory domains may be a wild-type immunomodulatory polypeptide or a variant of a wild-type immunomodulatory polypeptide, wherein the variant immunomodulatory polypeptide comprises 1, 2, 3, 4, 5, 6, 7, 8, 9, 10, 11, 12, 13, 14, 15, 16, 17, 18, 19, or 20 amino acid substitutions compared to the amino acid sequence of the corresponding wild-type immunomodulatory polypeptide; and optionally wherein at least one of the one or more immunomodulatory domains is a variant immunomodulatory polypeptide that exhibits reduced affinity to a cognate co-immunomodulatory polypeptide compared to the affinity of a corresponding wild-type immunomodulatory polypeptide for the cognate co-immunomodulatory polypeptide, and wherein the epitope binds to a T-cell receptor (TCR) on a T cell with an affinity of at least $10^{-7}$ M, such that: i) the T-cell modulatory multimeric polypeptide binds to a first T cell with an affinity that is at least 25% higher than the affinity with which the T-cell modulatory multimeric polypeptide binds a second T cell, wherein the first T cell expresses on its surface the cognate co-immunomodulatory polypeptide and a TCR that binds the epitope with an affinity of at least $10^{-7}$ M, and wherein the second T cell expresses on its surface the cognate co-immunomodulatory polypeptide but does not express on its surface a TCR that binds the epitope with an affinity of at least $10^{-7}$ M; and/or ii) the ratio of the binding affinity of a control T-cell modulatory multimeric polypeptide, wherein the control comprises a wild-type immunomodulatory polypeptide, to a cognate co-immunomodulatory polypeptide to the binding affinity of the T-cell modulatory multimeric polypeptide comprising a variant of the wild-type immunomodulatory polypeptide to the cognate co-immunomodulatory polypeptide, when measured by bio-layer interferometry, is in a range of from 1.5:1 to $10^6$:1; and wherein the variant immunomodulatory polypeptide comprises 1, 2, 3, 4, 5, 6, 7, 8, 9, 10, 11, 12, 13, 14, 15, 16, 17, 18, 19, or 20 amino acid substitutions compared to the amino acid sequence of the corresponding wild-type immunomodulatory polypeptide.

Aspect 2. The T-cell modulatory multimeric polypeptide of aspect 1, wherein the T-cell modulatory multimeric polypeptide binds to the first T cell with an affinity that is at least 50% higher than the affinity with which it binds the second T cell.

Aspect 3. The T-cell modulatory multimeric polypeptide of aspect 1, wherein the T-cell modulatory multimeric polypeptide binds to the first T cell with an affinity that is at least 2-fold higher than the affinity with which it binds the second T cell.

Aspect 4. The T-cell modulatory multimeric polypeptide of aspect 1, wherein the T-cell modulatory multimeric polypeptide binds to the first T cell with an affinity that is at least 5-fold higher than the affinity with which it binds the second T cell.

Aspect 5. The T-cell modulatory multimeric polypeptide of aspect 1, wherein the T-cell modulatory multimeric polypeptide binds to the first T cell with an affinity that is at least 10-fold higher than the affinity with which it binds the second T cell.

Aspect 6. The T-cell modulatory multimeric polypeptide of aspect 1, wherein the variant immunomodulatory polypeptide binds the co-immunomodulatory polypeptide with an affinity of from about $10^{-4}$ M to about $10^{-7}$ M.

Aspect 7. The T-cell modulatory multimeric polypeptide of aspect 1, wherein the variant immunomodulatory polypeptide binds the co-immunomodulatory polypeptide with an affinity of from about $10^4$ M to about $10^6$ M.

Aspect 8. The T-cell modulatory multimeric polypeptide of aspect 1, wherein the variant immunomodulatory polypeptide binds the co-immunomodulatory polypeptide with an affinity of from about $10^{-4}$ M to about $10^{-5}$ M.

Aspect 9. The T-cell modulatory multimeric polypeptide of aspect 1, wherein the ratio of the binding affinity of a control T-cell modulatory multimeric polypeptide, wherein the control comprises a wild-type immunomodulatory polypeptide, to a cognate co-immunomodulatory polypeptide to the binding affinity of the T-cell modulatory multimeric polypeptide comprising a variant of the wild-type immunomodulatory polypeptide to the cognate co-immunomodulatory polypeptide, when measured by bio-layer interferometry, is at least 10:1.

Aspect 10. The T-cell modulatory multimeric polypeptide of aspect 1, wherein the ratio of the binding affinity of a control T-cell modulatory multimeric polypeptide. wherein the control comprises a wild-type immunomodulatory polypeptide, to a cognate co-immunomodulatory polypeptide to the binding affinity of the T-cell modulatory multimeric polypeptide comprising a variant of the wild-type immunomodulatory polypeptide to the cognate co-immunomodulatory polypeptide, when measured by bio-layer interferometry, is at least 50:1.

Aspect 11. The T-cell modulatory multimeric polypeptide of aspect 1, wherein the ratio of the binding affinity of a control T-cell modulatory multimeric polypeptide, wherein the control comprises a wild-type immunomodulatory polypeptide, to a cognate co-immunomodulatory polypeptide to the binding affinity of a T-cell modulatory multimeric polypeptide of the present disclosure comprising a variant of the wild-type immunomodulatory polypeptide to the cognate co-immunomodulatory polypeptide, when measured by bio-layer interferometry, is at least $10^2$:1.

Aspect 12. The T-cell modulatory multimeric polypeptide of aspect 1, wherein the ratio of the binding affinity of a control T-cell modulatory multimeric polypeptide, wherein the control comprises a wild-type immunomodulatory polypeptide, to a cognate co-immunomodulatory polypeptide to the binding affinity of the T-cell modulatory multimeric polypeptide comprising a variant of the wild-type immunomodulatory polypeptide to the cognate co-immunomodulatory polypeptide, when measured by bio-layer interferometry, is at least $10^3$:1.

Aspect 13. The T-cell modulatory multimeric polypeptide of any one of aspects 1-12, wherein the second polypeptide comprises an Ig Fc polypeptide.

Aspect 14. The T-cell modulatory multimeric polypeptide of aspect 13, wherein the IgFc polypeptide is an IgG1 Fc polypeptide.

Aspect 15. The T-cell modulatory multimeric polypeptide of aspect 14, wherein the IgG1 Fc polypeptide comprises one or more amino acid substitutions selected from N297A, L234A, L235A, L234F, L235E, and P331S.

Aspect 16. The T-cell modulatory multimeric polypeptide of aspect 14, wherein the IgG1 Fc polypeptide comprises L234A and L235A substitutions.

Aspect 17. The T-cell modulatory multimeric polypeptide of any one of aspects 1-16, wherein the first polypeptide comprises a peptide linker between the epitope and the first MHC polypeptide.

Aspect 18. The T-cell modulatory multimeric polypeptide of aspect 17, wherein the linker has a length of from 20 amino acids to 40 amino acids.

Aspect 19. The T-cell modulatory multimeric polypeptide of aspect 17, wherein the linker is a peptide of the formula (GGGGS)n, where n is 1, 2, 3, 4, 5, 6, 7, or 8.

Aspect 20. The T-cell modulatory multimeric polypeptide of any one of aspects 1-19, wherein the first polypeptide comprises a peptide linker between the variant immunomodulatory polypeptide and the second MHC polypeptide.

Aspect 21. The T-cell modulatory multimeric polypeptide of aspect 18, wherein the linker has a length of from 20 amino acids to 40 amino acids.

Aspect 22. The T-cell modulatory multimeric polypeptide of aspect 20, wherein the linker is a peptide of the formula (GGGGS)n, where n is 1, 2, 3, 4, 5, 6, 7, or 8.

Aspect 23. The T-cell modulatory multimeric polypeptide of any one of aspects 1-22, comprising two or more copies of the variant immunomodulatory polypeptide.

Aspect 24. The T-cell modulatory multimeric polypeptide of aspect 23, wherein the two or more copies of the variant immunomodulatory polypeptide comprise the same amino acid sequence.

Aspect 25. The T-cell modulatory multimeric polypeptide of aspect 23 or aspect 24, comprising a peptide linker between the copies.

Aspect 26. The T-cell modulatory multimeric polypeptide of aspect 25, wherein the linker has a length of from 20 amino acids to 40 amino acids.

Aspect 27. The T-cell modulatory multimeric polypeptide of aspect 25, wherein the linker is a peptide of the formula (GGGGS)n, where n is 1, 2, 3, 4, 5, 6, 7, or 8.

Aspect 28. The T-cell modulatory multimeric polypeptide of any one of aspects 1-27, wherein the variant immunomodulatory polypeptide comprises from 1 to 10 amino acid substitutions relative to a corresponding wild-type immunomodulatory polypeptide.

Aspect 29. The T-cell modulatory multimeric polypeptide of aspect 28, wherein the wild-type immunomodulatory polypeptide is selected from the group consisting of IL-2, 4-1BBL, PD-L1, CD80, CD86, B7-1, ICOS-L, OX-40L, FasL, JAG1, TGFβ, and PD-L1.

Aspect 30. The T-cell modulatory multimeric polypeptide of any one of aspects 1-29, wherein the first MHC polypeptide is a β2-microglobulin polypeptide; and wherein the second MHC polypeptide is an MHC class I heavy chain polypeptide.

Aspect 31. The T-cell modulatory multimeric polypeptide of aspect 30, wherein the β2-microglobulin polypeptide comprises an amino acid sequence having at least 85% amino acid sequence identity to one of the amino acid sequences set forth in FIG. 7.

Aspect 32. The T-cell modulatory multimeric polypeptide of aspect 30, wherein the MHC class I heavy chain polypeptide is an HLA-A, an HLA-B, or an HLA-C heavy chain.

Aspect 33. The T-cell modulatory multimeric polypeptide of aspect 32, wherein the MHC class I heavy chain polypeptide comprises an amino acid sequence having at least 85% amino acid sequence identity to the amino acid sequence set forth in one of FIG. 6A-6C or having at least 85% amino acid sequence identity to the amino acid sequence set forth in one of FIG. 8A-8K.

Aspect 34. The T-cell modulatory multimeric polypeptide of any one of aspects 1-29, wherein the first MHC polypeptide is an MHC Class II alpha chain polypeptide; and wherein the second MHC polypeptide is an MHC class II beta chain polypeptide.

Aspect 35. The T-cell modulatory multimeric polypeptide of any one of aspects 1-34, wherein multimeric polypeptide comprises an Fc polypeptide, and wherein the Ig Fc polypeptide is an IgG1 Fc polypeptide, an IgG2 Fc polypeptide, an IgG3 Fc polypeptide, an IgG4 Fc polypeptide, an IgA Fc polypeptide, or an IgM Fc polypeptide.

Aspect 36. The T-cell modulatory multimeric polypeptide of aspect 26, wherein the Ig Fc polypeptide comprises an amino acid sequence having at least 85% amino acid sequence identity to an amino acid sequence depicted in one of FIG. 5A-5D.

Aspect 37. The T-cell modulatory multimeric polypeptide of aspect 35 or 36, wherein the second polypeptide comprises a peptide linker between second MHC polypeptide and the Fc polypeptide.

Aspect 38. The T-cell modulatory multimeric polypeptide of aspect 37, wherein the linker has a length of from 5 amino acids to 50 amino acids.

Aspect 39. The T-cell modulatory multimeric polypeptide of aspect 37, wherein the linker is a peptide of the formula (GGGGS)n, where n is 1, 2, 3, 4, 5, 6, 7, or 8.

Aspect 40. The T-cell modulatory multimeric polypeptide of any one of aspects 1-39, wherein the first polypeptide and the second polypeptide are non-covalently associated.

Aspect 41. The T-cell modulatory multimeric polypeptide of any one of aspects 1-39, wherein the first polypeptide and the second polypeptide are covalently linked to one another.

Aspect 42. The T-cell modulatory multimeric polypeptide of aspect 41, wherein the covalent linkage is via a disulfide bond.

Aspect 43. The T-cell modulatory multimeric polypeptide of aspect 42, wherein the disulfide bond links a cysteine residue in the first MHC polypeptide with a cysteine residue in the second MHC polypeptide.

Aspect 44. The T-cell modulatory multimeric polypeptide of any one of aspects 1-43, wherein the epitope is a cancer epitope.

Aspect 45. The T-cell modulatory multimeric polypeptide of aspect 44, wherein the cancer epitope is a peptide fragment of 4 amino acids (aa), 5 aa, 6 aa, 7 aa, 8 aa, 9 aa, 10 aa, 11 aa, 12 aa, 13 aa, 14 aa, 15 aa, 16 aa, 17 aa, 18 aa, 19 aa, or 20 aa in length of a MUC1 polypeptide, a human papillomavirus (HPV) E6 polypeptide, an LMP2 polypeptide, an HPV E7 polypeptide, an epidermal growth factor receptor (EGFR) vIII polypeptide, a HER-2/neu polypeptide, a melanoma antigen family A, 3 (MAGE A3) polypeptide, a p53 polypeptide, a mutant p53 polypeptide, an NY-ESO-1 polypeptide, a folate hydrolase (prostate-specific membrane antigen; PSMA) polypeptide, a carcinoembryonic antigen (CEA) polypeptide, a melanoma antigen recognized by T-cells (melanA/MART1) polypeptide, a Ras polypeptide, a gp100 polypeptide, a proteinase3 (PR1) polypeptide, a bcr-abl polypeptide, a tyrosinase polypeptide, a survivin polypeptide, a prostate specific antigen (PSA) polypeptide, an hTERT polypeptide, a sarcoma translocation breakpoints polypeptide, a synovial sarcoma X (SSX) breakpoint polypeptide, an EphA2 polypeptide, an acid phosphatase, prostate (PAP) polypeptide, a melanoma inhibitor of apoptosis (ML-IAP) polypeptide, an alpha-fetoprotein (AFP) polypeptide, an epithelial cell adhesion molecule (EpCAM) polypeptide, an ERG (TMPRSS2 ETS fusion) polypeptide, a NA17 polypeptide, a paired-box-3 (PAX3) polypeptide, an anaplastic lymphoma kinase (ALK) polypeptide, an androgen receptor polypeptide, a cyclin B1 polypeptide, an N-myc proto-oncogene (MYCN) polypeptide, a Ras homolog gene family member C (RhoC) polypeptide, a tyrosinase-related protein-2 (TRP-2) polypeptide, a mesothelin polypeptide, a prostate stem cell antigen (PSCA) polypeptide, a melanoma associated antigen-1 (MAGE A1) polypeptide, a cytochrome P450 1B1 (CYP1B1) polypeptide, a placenta-specific protein 1 (PLAC1) polypeptide, a BORIS polypeptide (also known as CCCTC-binding factor or CTCF), an ETV6-AML polypeptide, a breast cancer antigen NY-BR-1 polypeptide (also referred to as ankyrin repeat domain-containing protein 30A), a regulator of G-protein signaling (RGS5) polypeptide, a squamous cell carcinoma antigen recognized by T-cells (SART3) polypeptide, a carbonic anhydrase IX polypeptide, a paired box-5 (PAX5) polypeptide, an OY-TES1 (testis antigen; also known as acrosin binding protein) polypeptide, a sperm protein 17 polypeptide, a lymphocyte cell-specific protein-tyrosine kinase (LCK) polypeptide, a high molecular weight melanoma associated antigen (HMW-MAA), an A-kinase anchoring protein-4 (AKAP-4), a synovial sarcoma X breakpoint 2 (SSX2) polypeptide, an X antigen family member 1 (XAGE1) polypeptide, a B7 homolog 3 (B7H3; also known as CD276) polypeptide, a legumain polypeptide (LGMN1; also known as asparaginyl endopeptidase), a tyrosine kinase with Ig and EGF homology domains-2 (Tie-2; also known as angiopoietin-1 receptor) polypeptide, a P antigen family member 4 (PAGE4) polypeptide, a vascular endothelial growth factor receptor 2 (VEGF2) polypeptide, a MAD-CT-1 polypeptide, a fibroblast activation protein (FAP) polypeptide, a platelet derived growth factor receptor beta (PDGFβ) polypeptide, a MAD-CT-2 polypeptide, a Fos-related antigen-1 (FOSL) polypeptide, or a Wilms tumor-1 (WT1) polypeptide.

Aspect 46. The T-cell modulatory multimeric polypeptide of any one of aspects 1-45, wherein one of the first and the second polypeptide comprises an Ig Fc polypeptide, wherein a drug is conjugated to the Ig Fc polypeptide.

Aspect 47. The T-cell modulatory multimeric polypeptide of aspect 46, wherein the drug is a cytotoxic agent is selected from maytansinoid, benzodiazepine, taxoid, CC-1065, duocarmycin, a duocarmycin analog, calicheamicin, dolastatin, a dolastatin analog, auristatin, tomaymycin, and leptomycin, or a pro-drug of any one of the foregoing.

Aspect 48. The T-cell modulatory multimeric polypeptide of aspect 46, wherein the drug is a retinoid.

Aspect 49. The T-cell modulatory multimeric polypeptide of any one of aspects 1-48, wherein the binding affinity is determined by bio-layer interferometry.

Aspect 50. A method of modulating an immune response in an individual, the method comprising administering to the individual an effective amount of the T-cell modulatory multimeric polypeptide of any one of aspects 1-49, wherein said administering induces an epitope-specific T cell response and an epitope-non-specific T cell response, wherein the ratio of the epitope-specific T cell response to the epitope-non-specific T cell response is at least 2:1.

Aspect 51. The method of aspect 50, wherein the ratio of the epitope-specific T cell response to the epitope-non-specific T cell response is at least 5:1.

Aspect 52. The method of aspect 50, wherein the ratio of the epitope-specific T cell response to the epitope-non-specific T cell response is at least 10:1.

Aspect 53. The method of aspect 50, wherein the ratio of the epitope-specific T cell response to the epitope-non-specific T cell response is at least 25:1.

Aspect 54. The method of aspect 50, wherein the ratio of the epitope-specific T cell response to the epitope-non-specific T cell response is at least 50:1.

Aspect 55. The method of aspect 50, wherein the ratio of the epitope-specific T cell response to the epitope-non-specific T cell response is at least 100:1.

Aspect 56. The method of any one of aspects 50-55, wherein the individual is a human.

Aspect 57. The method of any one of aspects 50-56, wherein said modulating comprises increasing a cytotoxic T-cell response to a cancer cell.

Aspect 58. The method of any one of aspects 50-57, wherein said modulating comprises reducing a T-cell response to an autoantigen.

Aspect 59. The method of any one of aspects 50-58, wherein said administering is intravenous, subcutaneous, intramuscular, systemic, intralymphatic, distal to a treatment site, local, or at or near a treatment site.

Aspect 60. The method of any one of aspects 50-59, wherein the epitope non-specific T-cell response is less than the epitope non-specific T-cell response that would be induced by a control T-cell modulatory multimeric polypeptide comprising a corresponding wild-type immunomodulatory polypeptide.

Aspect 61. A method of treating cancer in an individual, the method comprising administering to the individual an effective amount of a T-cell modulatory multimeric polypeptide of any one of aspects 1-49.

Aspect 62. One or more nucleic acids comprising nucleotide sequences encoding the first and the second polypeptide of the T-cell modulatory multimeric polypeptide of any one of aspects 1-49.

Aspect 63. The one or more nucleic acids of aspect 62, wherein the first polypeptide is encoded by a first nucleotide sequence, the second polypeptide is encoded by a second nucleotide sequence, and wherein the first and the second nucleotide sequences are present in a single nucleic acid.

Aspect 64. The one or more nucleic acids of aspect 62, wherein the first polypeptide is encoded by a first nucleotide sequence present in a first nucleic acid, and the second polypeptide is encoded by a second nucleotide sequence present in a second nucleic acid.

Aspect 65. The one or more nucleic acids of aspect 63, wherein the first nucleotide sequence and the second nucleotide sequence are operably linked to a transcriptional control element.

Aspect 66. The one or more nucleic acids of aspect 64, wherein the first nucleotide sequence is operably linked to a transcriptional control element and the second nucleotide sequence is operably linked to a transcriptional control element.

Aspect 67. The one or more nucleic acids of aspect 63, wherein the single nucleic acid is present in a recombinant expression vector.

Aspect 68. The one or more nucleic acids of aspect 67, wherein the first nucleic acid is present in a first recombinant expression vector and the second nucleic acid is present in a second recombinant expression vector.

Aspect 69. A composition comprising: a) the T-cell modulatory multimeric polypeptide of any one of aspects 1-49; and b) a pharmaceutically acceptable excipient.

Aspect 70. A composition comprising: a) the one or more nucleic acids of any one of aspects 62-68; and b) a pharmaceutically acceptable excipient.

Aspect 71. A composition comprising: a) the T-cell modulatory multimeric polypeptide of any one of aspects 1-49; and b) saline.

Aspect 72. The composition of aspect 71, wherein the saline is 0.9% NaCl.

Aspect 73. The composition of aspect 71 or 72, wherein the composition is sterile.

Aspect 74. A method of obtaining a T-cell modulatory multimeric polypeptide comprising one or more variant immunomodulatory polypeptides that exhibit reduced affinity for a cognate co-immunomodulatory polypeptide compared to the affinity of the corresponding parental wild-type immunomodulatory polypeptide for the co-immunomodulatory polypeptide, the method comprising selecting, from a library of T-cell modulatory multimeric polypeptides comprising a plurality of members, a member that exhibits reduced affinity for the cognate co-immunomodulatory polypeptide, wherein the plurality of member comprises: a) a first polypeptide comprising: i) an epitope; and ii) a first major histocompatibility complex (MHC) polypeptide; and b) a second polypeptide comprising: i) a second MHC polypeptide; and ii) optionally an immunoglobulin (Ig) Fc polypeptide or a non-Ig scaffold, wherein the members of the library comprise a plurality of variant immunomodulatory polypeptide present in the first polypeptide, the second polypeptide, or both the first and the second polypeptide.

Aspect 75. A method of obtaining a T-cell modulatory multimeric polypeptide comprising one or more variant immunomodulatory polypeptides that exhibit reduced affinity for a cognate co-immunomodulatory polypeptide compared to the affinity of the corresponding parental wild-type immunomodulatory polypeptide for the co-immunomodulatory polypeptide, the method comprising: A) providing a library of T-cell modulatory multimeric polypeptides comprising a plurality of members, wherein the plurality of member comprises: a) a first polypeptide comprising: i) an epitope; and ii) a first major histocompatibility complex (MHC) polypeptide; and b) a second polypeptide comprising: i) a second MHC polypeptide; and optionally an immunoglobulin (Ig) Fc polypeptide or a non-Ig scaffold, wherein the members of the library comprise a plurality of variant immunomodulatory polypeptide present in the first polypeptide, the second polypeptide, or both the first and the second polypeptide; and B) selecting from the library a member that exhibits reduced affinity for the cognate co-immunomodulatory polypeptide.

Aspect 76. The method of aspect 74 or 75, wherein said selecting comprises determining the affinity, using bio-layer interferometry, of binding between T-cell modulatory multimeric polypeptide library members and the cognate co-immunomodulatory polypeptide.

Aspect 77. The method of any one of aspects 74-76, wherein the T-cell modulatory multimeric polypeptide is as defined in any one of aspects 1-49.

Aspect 78. The method of any one of aspects 74-77, further comprising: a) contacting the selected T-cell modulatory multimeric polypeptide library member with a target T-cell expressing on its surface: i) a cognate co-immunomodulatory polypeptide that binds the parental wild-type immunomodulatory polypeptide; and ii) a T-cell receptor that binds to the epitope, wherein the T-cell modulatory multimeric polypeptide library member comprises an epitope tag, such that the T-cell modulatory multimeric polypeptide library member binds to the target T-cell; b) contacting the selected T-cell modulatory multimeric polypeptide library member bound to the target T-cell with a fluorescently labeled binding agent that binds to the epitope tag, generating a selected T-cell modulatory multimeric polypeptide library member/target T-cell/binding agent complex; and c) measuring the mean fluorescence intensity (MFI) of the selected T-cell modulatory multimeric polypeptide library member/target T-cell/binding agent complex using flow cytometry, wherein the MFI measured over a range of concentrations of the selected T-cell modulatory multimeric polypeptide library member provides a measure of the affinity and apparent avidity; wherein a selected T-cell modulatory multimeric polypeptide library member that selectively binds the target T cell, compared to binding of the T-cell modulatory multimeric polypeptide library member to a control T cell that comprises: i) the cognate co-immunomodulatory polypeptide that binds the parental wild-type immunomodulatory polypeptide; and ii) a T-cell receptor that binds to an epitope other than the epitope present in the T-cell modulatory multimeric polypeptide library member, is identified as selectively binding to the target T cell.

Aspect 79. The method of aspect 78, wherein the binding agent is an antibody specific for the epitope tag.

Aspect 80. The method of any one of aspects 74-79, wherein the variant immunomodulatory polypeptide comprises from 1 to 20, amino acid substitutions compared to the corresponding parental wild-type immunomodulatory polypeptide.

Aspect 81. The method of any one of aspects 74-80, wherein the T-cell modulatory multimeric polypeptide comprises two variant immunomodulatory polypeptides.

Aspect 82. The method of aspect 81, wherein the two variant immunomodulatory polypeptides comprise the same amino acid sequence.

Aspect 83. The method of aspect 81 or 82, wherein the first polypeptide comprises one of the two variant immunomodulatory polypeptides and wherein the second polypeptide comprises the second of the two variant immunomodulatory polypeptides.

Aspect 84. The method of aspect 81 or 82, wherein the two variant immunomodulatory polypeptides are on the same polypeptide chain of the T-cell modulatory multimeric polypeptide.

Aspect 85. The method of aspect 84, wherein the two variant immunomodulatory polypeptides are on the first polypeptide of the T-cell modulatory multimeric polypeptide.

Aspect 86. The method of aspect 84, wherein the two variant immunomodulatory polypeptides are on the second polypeptide of the T-cell modulatory multimeric polypeptide.

Aspect 87. The method of any one of aspects 74-86, further comprising isolating the selected T-cell modulatory multimeric polypeptide library member from the library.

Aspect 88. The method of any one of aspects 74-87, further comprising providing a nucleic acid comprising a nucleotide sequence encoding the selected T-cell modulatory multimeric polypeptide library member.

Aspect 89. The method of aspect 88, wherein the nucleic acid is present in a recombinant expression vector.

Aspect 90. The method of aspect 88 or 89, wherein the nucleotide sequence is operably linked to a transcriptional control element that is functional in a eukaryotic cell.

Aspect 91. The method of any one of aspects 88-90, further comprising introducing the nucleic acid into a eukaryotic host cell, and culturing the cell in a liquid medium to synthesize the encoded selected T-cell modulatory multimeric polypeptide library member in the cell.

Aspect 92. The method of aspect 91, further comprising isolating the synthesized selected T-cell modulatory multimeric polypeptide library member from the cell or from liquid culture medium comprising the cell.

Aspect 93. The method of any one of aspects 74-92, wherein the selected T-cell modulatory multimeric polypeptide library member comprises an Ig Fc polypeptide.

Aspect 94. The method of aspect 93, further comprising conjugating a drug to the Ig Fc polypeptide.

Aspect 95. The method of aspect 94, wherein the drug is a cytotoxic agent is selected from maytansinoid, benzodiazepine, taxoid, CC-1065, duocarmycin, a duocarmycin analog, calicheamicin, dolastatin, a dolastatin analog, auristatin, tomaymycin, and leptomycin, or a pro-drug of any one of the foregoing.

Aspect 96. The method of aspect 94, wherein the drug is a retinoid.

Aspect 97. The method of any one of aspects 74-96, wherein the parental wild-type immunomodulatory polypeptide and the cognate immunomodulatory polypeptides are selected from: IL-2 and IL-2 receptor; 4-1BBL and 4-1BB; PD-L1 and PD-1; FasL and Fas; TGFβ and TGFβ receptor; CD80 and CD28; CD86 and CD28; OX40L and OX40; FasL and Fas; ICOS-L and ICOS; ICAM and LFA-1; JAG1 and Notch; JAG1 and CD46; CD80 and CTLA4; and CD86 and CTLA4.

Aspect 98. A multimeric T-cell modulatory polypeptide comprising: A) a first multimeric polypeptide heterodimer according to any of aspects 1-49, and B) a second multimeric polypeptide heterodimer according to any of aspects 1-49, and wherein the first heterodimer and the second heterodimer are covalently linked to one another.

Aspect 99. The multimeric T-cell modulatory polypeptide of aspect 98, wherein the first heterodimer and the second heterodimer are covalently linked to one another via a C-terminal region of the second polypeptide of the first heterodimer and a C-terminal region of the second polypeptide of the second heterodimer.

Aspect 100. The multimeric T-cell modulatory polypeptide of aspect 98 or 99, wherein the peptide epitope of the first heterodimer and the peptide epitope of the second heterodimer comprise the same amino acid sequence.

Aspect 101. The multimeric T-cell modulatory polypeptide of any one of aspects 98-100, wherein the first MHC polypeptide of the first and the second heterodimer is an MHC Class I β2-microglobulin, and wherein the second MHC polypeptide of the first and the second heterodimer is an MHC Class I heavy chain.

Aspect 102. The multimeric T-cell modulatory polypeptide of any one of aspects 98-101, wherein the one or more immunomodulatory polypeptides of the first heterodimer and the one or more immunomodulatory polypeptides of the second heterodimer comprise the same amino acid sequence or comprise a different amino acid sequence.

Aspect 103. The multimeric T-cell modulatory polypeptide of any one of aspects 98-102, wherein the one or more immunomodulatory polypeptides of the first heterodimer and the one or more immunomodulatory polypeptides of the second heterodimer are variant immunomodulatory polypeptides that comprise from 1 to 10 amino acid substitutions compared to a corresponding parental wild-type immunomodulatory polypeptide, and wherein the from 1 to 10 amino acid substitutions result in reduced affinity binding of the variant immunomodulatory polypeptide to a cognate co-immunomodulatory polypeptide.

Aspect 104. The multimeric T-cell modulatory polypeptide of any one of aspects 98-103, wherein the one or more immunomodulatory polypeptides of the first heterodimer and the one or more immunomodulatory polypeptides of the second heterodimer are selected from the group consisting of IL-2, 4-1BBL, PD-L1, CD80, CD86, B7-1, ICOS-L, OX-40L. FasL, JAG1, TGFβ, PD-L1, variants of IL-2, 4-1BBL, PD-L1, CD80, CD86, B7-1, ICOS-L, OX-40L, FasL, JAG1, TGFβ, and PD-L1, and combinations thereof.

Aspect 105. The multimeric T-cell modulatory polypeptide of aspect 103, wherein the parental wild-type immunomodulatory polypeptide and the cognate immunomodulatory polypeptides are selected from: IL-2 and IL-2 receptor; 4-1BBL and 4-1BB; PD-L1 and PD-1; FasL and Fas; TGFβ and TGFβ receptor; CD80 and CD28; OX40L and OX40; FasL and Fas; ICOS-L and ICOS; ICAM and LFA-1; JAG1 and Notch; JAG1 and CD46; CD80 and CTLA4; and CD86 and CTLA4.

Aspect 106. The multimeric T-cell modulatory polypeptide of any one of aspects 98-105, wherein the peptide epitope is a cancer epitope.

Aspect 107. The multimeric T-cell modulatory polypeptide of aspect 106, wherein the cancer epitope is a peptide fragment of 4 amino acids (aa), 5 aa, 6 aa, 7 aa, 8 aa, 9 aa, 10 aa, 11 aa, 12 aa, 13 aa, 14 aa, 15 aa, 16 aa, 17 aa, 18 aa, 19 aa, or 20 aa in length of a MUC1 polypeptide, a human papillomavirus (HPV) E6 polypeptide, an LMP2 polypeptide, an HPV E7 polypeptide, an epidermal growth factor receptor (EGFR) vIII polypeptide, a HER-2/neu polypeptide, a melanoma antigen family A, 3 (MAGE A3) polypeptide, a p53 polypeptide, a mutant p53 polypeptide, an NY-ESO-1 polypeptide, a folate hydrolase (prostate-specific membrane antigen; PSMA) polypeptide, a carcinoembryonic antigen (CEA) polypeptide, a melanoma antigen recognized by T-cells (melanA/MART1) polypeptide, a Ras polypeptide. a gp100 polypeptide, a proteinase3 (PR1) polypeptide, a bcr-abl polypeptide, a tyrosinase polypeptide, a survivin polypeptide, a prostate specific antigen (PSA) polypeptide, an hTERT polypeptide, a sarcoma translocation breakpoints polypeptide, a synovial sarcoma X (SSX) breakpoint polypeptide, an EphA2 polypeptide, an acid phosphatase, prostate (PAP) polypeptide, a melanoma inhibitor of apoptosis (ML-IAP) polypeptide, an alpha-fetoprotein (AFP) polypeptide, an epithelial cell adhesion molecule (EpCAM) polypeptide, an ERG (TMPRSS2 ETS fusion) polypeptide. a NA17 polypeptide, a paired-box-3 (PAX3) polypeptide, an anaplastic lymphoma kinase (ALK) polypeptide, an androgen receptor polypeptide, a cyclin B1 polypeptide, an N-myc proto-oncogene (MYCN) polypeptide, a Ras homolog gene family member C (RhoC) polypeptide, a tyrosinase-related protein-2 (TRP-2) polypeptide, a mesothelin polypeptide, a prostate stem cell antigen (PSCA) polypeptide, a melanoma associated antigen-1 (MAGE A1) polypeptide, a cytochrome P450 1B1 (CYP1B1) polypeptide, a placenta-specific protein 1 (PLAC1) polypeptide, a BORIS polypeptide (also known as CCCTC-binding factor or CTCF), an ETV6-AML polypeptide, a breast cancer antigen NY-BR-1 polypeptide (also referred to as ankyrin repeat domain-containing protein 30A), a regulator of G-protein signaling (RGS5) polypeptide, a squamous cell carcinoma antigen recognized by T-cells (SART3) polypeptide, a carbonic anhydrase IX polypeptide, a paired box-5 (PAX5) polypeptide, an OY-TES1 (testis antigen; also known as acrosin binding protein) polypeptide, a sperm protein 17 polypeptide, a lymphocyte cell-specific protein-tyrosine kinase (LCK) polypeptide, a high molecular weight melanoma associated antigen (HMW-MAA), an A-kinase anchoring protein-4 (AKAP-4), a synovial sarcoma X breakpoint 2 (SSX2) polypeptide, an X antigen family member 1 (XAGE1) polypeptide, a B7 homolog 3 (B7H3; also known as CD276) polypeptide, a legumain polypeptide (LGMN1; also known as asparaginyl endopeptidase), a tyrosine kinase with Ig and EGF homology domains-2 (Tie-2; also known as angiopoietin-1 receptor) polypeptide, a P antigen family member 4 (PAGE4) polypeptide, a vascular endothelial growth factor receptor 2 (VEGF2) polypeptide, a MAD-CT-1 polypeptide, a fibroblast activation protein (FAP) polypeptide, a platelet derived growth factor receptor beta (PDGFβ) polypeptide, a MAD-CT-2 polypeptide, a Fos-related antigen-1 (FOSL) polypeptide, or a Wilms tumor-1 (WT1) polypeptide.

Aspect 108. A method of delivering a costimulatory (i.e., immunomodulatory) polypeptide selectively to target T cell, the method comprising contacting a mixed population of T cells with a multimeric polypeptide of any one of aspects 1-49 and 98-107, wherein the mixed population of T cells comprises the target T cell and non-target T cells, wherein the target T cell is specific for the epitope present within the multimeric polypeptide, and wherein said contacting delivers the one or more costimulatory polypeptides present within the multimeric polypeptide to the target T cell.

Aspect 109. The method of aspect 108, wherein the population of T cells is in vitro.

Aspect 110. The method of aspect 108, wherein the population of T cells is in vivo in an individual.

Aspect 111. The method of aspect 110, comprising administering the multimeric polypeptide to the individual.

Aspect 112. The method of any one of aspects 108-111, wherein the target T cell is a regulatory T cell.

Aspect 113. The method of any one of aspects 108-111, wherein the target T cell is a cytotoxic T cell.

Aspect 114. The method of aspect 108, wherein the mixed population of T cells is an in vitro population of mixed T cells obtained from an individual, and wherein said contacting results in activation and/or proliferation of the target T cell, generating a population of activated and/or proliferated target T cells.

Aspect 115. The method of aspect 114, further comprising administering the population of activated and/or proliferated target T cells to the individual.

Aspect 116. A method of detecting, in a mixed population of T cells obtained from an individual, the presence of a target T cell that hinds an epitope of interest, the method comprising: a) contacting in vitro the mixed population of T cells with the multimeric polypeptide of any one of aspects 1-49 and 98-107, wherein the multimeric polypeptide comprises the epitope of interest; and b) detecting activation and/or proliferation of T cells in response to said contacting, wherein activated and/or proliferated T cells indicates the presence of the target T cell.

Aspect 117. The method of aspects 108-115, wherein the one or more costimulatory polypeptides of the first heterodimer are selected from the group consisting of IL-2, 4-1BBL, PD-L1, CD80, CD86, B7-1, ICOS-L, OX-40L, FasL, JAG1, TGFβ, PD-L1, variants of IL-2, 4-1BBL, PD-L1, CD80, CD86, B7-1, ICOS-L, OX-40L, FasL, JAG1, TGFβ, and PD-L1, and combinations thereof, and wherein the one or more costimulatory polypeptides of the second heterodimer are selected from the group consisting of IL-2, 4-1BBL, PD-L1, CD80, CD86, B7-1, ICOS-L, OX-40L, FasL, JAG1, TGFβ, PD-L1, variants of IL-2, 4-1BBL, PD-L1, CD80, CD86, B7-1, ICOS-L, OX-40L, FasL, JAG1, TGFβ, and PD-L1, and combinations thereof.

Aspect 118. The method of aspect 117, wherein the one or more costimulatory polypeptides of the first heterodimer are selected from the group consisting of IL-2, a variant of IL-2, and combinations thereof, and the one or more costimulatory polypeptides of the second heterodimer are selected from the group consisting of IL-2, a variant of IL-2, and combinations thereof.

Aspect 119. The method of aspect 117, wherein the one or more costimulatory polypeptides of the first heterodimer are selected from the group consisting of 4-1BBL, a variant of 4-1BBL, and combinations thereof, and the one or more costimulatory polypeptides of the second heterodimer are selected from the group consisting of 4-1BBL, a variant of 4-1BBL, and combinations thereof.

Aspect 120. The method of aspect 117, wherein the one or more costimulatory polypeptides of the first heterodimer are selected from the group consisting of CD80, a variant of CD80, and combinations thereof, and the one or more costimulatory polypeptides of the second heterodimer are selected from the group consisting of CD80, a variant of CD80, and combinations thereof.

Aspect 121. The method of aspect 117, wherein the first heterodimer comprises at least two costimulatory polypeptides that are each independently selected from the group consisting of IL-2, 4-1BBL, PD-L1, CD80, CD86, B7-1, ICOS-L, OX-40L, FasL, JAG1, TGFβ, and PD-L1, and variants of IL-2, 4-1BBL, PD-L1, CD80, CD86, B7-1, ICOS-L, OX-40L, FasL, JAG1, TGFβ, and PD-L1, and wherein the second heterodimer comprises at least two costimulatory polypeptides that are each independently selected from the group consisting of IL-2, 4-1BBL, PD-L1, CD80, CD86, B7-1, ICOS-L, OX-40L, FasL, JAG1, TGFβ, and PD-L1, and variants of IL-2, 4-1BBL, PD-L1, CD80, CD86, B7-1, ICOS-L, OX-40L, FasL, JAG1, TGFβ, and PD-L1.

Aspect 122. The method of aspect 121, wherein each of the at least two costimulatory polypeptides of the first heterodimer is independently selected from the group consisting of IL-2 and variants of IL-2, and each of the at least two costimulatory polypeptides of the second heterodimer is independently selected from the group consisting of IL-2 and variants of IL-2.

Aspect 123. The method of aspect 121, wherein each of the at least two costimulatory polypeptides of the first heterodimer is independently selected from the group consisting of 4-1BBL and variants of 4-1BBL, and each of the at least two costimulatory polypeptides of the second heterodimer is independently selected from the group consisting of 4-1BBL and variants of 4-1BBL.

Aspect 124. The method of aspect 121, wherein each of the at least two costimulatory polypeptides of the first heterodimer is independently selected from the group consisting of CD80 and variants of CD80, and each of the at least two costimulatory polypeptides of the second heterodimer is independently selected from the group consisting of CD80 and variants of CD80.

Aspect 125. The method of aspect 121, wherein at least one of the at least two costimulatory polypeptides of the first heterodimer is CD80 or a variant of CD80, and at least one of the at least two costimulatory polypeptides of the first heterodimer is 4-1BBL or a variant of 4-1BBL, and wherein at least one of the at least two costimulatory polypeptides of the second heterodimer is CD80 or a variant of CD80, and at least one of the at least two costimulatory polypeptides of the second heterodimer is 4-1BBL or a variant of 4-1BBL.

Aspect 126. The multimeric T-cell modulatory polypeptide of any one of aspects 98-107, wherein the one or more immunomodulatory (i.e., costimulatory) polypeptides of the first heterodimer are selected from the group consisting of IL-2, 4-1BBL, PD-L1, CD80. CD86, B7-1, ICOS-L, OX-40L, FasL, JAG1, TGFβ, PD-L1, variants of IL-2, 4-1BBL, PD-L1, CD80, CD86, B7-1, ICOS-L, OX-40L, FasL, JAG1, TGFβ, and PD-L1, and combinations thereof, and wherein the one or more immunomodulatory (i.e., costimulatory) polypeptides of the second heterodimer are selected from the group consisting of IL-2, 4-1BBL, PD-L1, CD80, CD86, B7-1, ICOS-L, OX-40L, FasL, JAG1, TGFβ, PD-L1, variants of IL-2, 4-1BBL, PD-L1, CD80, CD86, B7-1, ICOS-L, OX-40L, FasL, JAG1, TGFβ, and PD-L1, and combinations thereof.

Aspect 127. The multimeric T-cell modulatory polypeptide of aspect 126, wherein the one or more immunomodulatory polypeptides of the first heterodimer are selected from the group consisting of IL-2, a variant of IL-2, and combinations thereof, and the one or more immunomodulatory polypeptides of the second heterodimer are selected from the group consisting of IL-2, a variant of IL-2, and combinations thereof.

Aspect 128. The multimeric T-cell modulatory polypeptide of aspect 126, wherein the one or more immunomodulatory polypeptides of the first heterodimer are selected from the group consisting of 4-1BBL, a variant of 4-1BBL, and combinations thereof, and the one or more immunomodulatory polypeptides of the second heterodimer are selected from the group consisting of 4-1BBL, a variant of 4-1BBL, and combinations thereof.

Aspect 129. The multimeric T-cell modulatory polypeptide of aspect 126, wherein the one or more immunomodulatory polypeptides of the first heterodimer are selected from the group consisting of CD80, a variant of CD80, and combinations thereof, and the one or more immunomodulatory polypeptides of the second heterodimer are selected from the group consisting of CD80, a variant of CD80, and combinations thereof.

Aspect 130. The multimeric T-cell modulatory polypeptide of aspect 126, wherein the first heterodimer comprises at least two immunomodulatory polypeptides that are each independently selected from the group consisting of IL-2, 4-1BBL, PD-L1, CD80, CD86, B7-1, ICOS-L, OX-40L, FasL, JAG1, TGFβ, and PD-L1, and variants of IL-2, 4-1BBL, PD-L1, CD80, CD86, B7-1, ICOS-L, OX-40L, FasL, JAG1, TGFβ, and PD-L1, and wherein the second heterodimer comprises at least two immunomodulatory polypeptides that are each independently selected from the group consisting of IL-2, 4-1BBL, PD-L1, CD80, CD86, B7-1, ICOS-L, OX-40L, FasL, JAG1, TGFβ, and PD-L1, and variants of IL-2, 4-1BBL, PD-L1, CD80, CD86, B7-1, ICOS-L, OX-40L, FasL, JAG1, TGFβ, and PD-L1.

Aspect 131. The multimeric T-cell modulatory polypeptide of aspect 130, wherein each of the at least two immunomodulatory polypeptides of the first heterodimer is independently selected from the group consisting of IL-2 and variants of IL-2, and each of the at least two immunomodulatory polypeptides of the second heterodimer is independently selected from the group consisting of IL-2 and a variant of IL-2.

Aspect 132. The multimeric T-cell modulatory polypeptide of aspect 130, wherein each of the at least two immunomodulatory polypeptides of the first heterodimer is independently selected from the group consisting of 4-1BBL and variants of 4-1BBL, and each of the at least two immunomodulatory polypeptides of the second heterodimer is independently selected from the group consisting of 4-1BBL and variants of 4-1BBL.

Aspect 133. The multimeric T-cell modulatory polypeptide of aspect 130, wherein each of the at least two immunomodulatory polypeptides of the first heterodimer is independently selected from the group consisting of CD80 and variants of CD80, and each of the at least two immunomodulatory polypeptides of the second heterodimer is independently selected from the group consisting of CD80 and variants of CD80.

Aspect 134. The multimeric T-cell modulatory polypeptide of aspect 130, wherein at least one of the at least two immunomodulatory polypeptides of the first heterodimer is CD80 or a variant of CD80, and at least one of the at least two immunomodulatory polypeptides of the first heterodimer is 4-1BBL or a variant of 4-1BBL, and wherein at least one of the at least two immunomodulatory polypeptides of the second heterodimer is CD80 or a variant of CD80, and at least one of the at least two immunomodulatory polypeptides of the second heterodimer is 4-1BBL or a variant of 4-1BBL.

Aspect 135. The multimeric T-cell modulatory polypeptide of any of aspects 1-49 and 98-107, and 125-134, wherein the epitope is a hepatitis B virus epitope selected from the group consisting of GLSRYVARLG (SEQ ID NO:239), KLHLYSHPI (SEQ ID NO:240); FLLSLGIHL (SEQ ID NO:241), ALMPLYACI (SEQ ID NO:242), and SLYADSPSV (SEQ ID NO:243).

Aspect 136. The method of any of any one of aspects 108-115 and 117-125, wherein the epitope is a hepatitis B virus epitope selected from the group consisting of GLSRYVARLG (SEQ ID NO:239), KLHLYSHPI (SEQ ID NO:240); FLLSLGIHL (SEQ ID NO:241), ALMPLYACI (SEQ ID NO:242), and SLYADSPSV (SEQ ID NO:243).

Aspect 137. The multimeric T-cell modulatory polypeptide of any of aspects 1-49 and 98-107, and 125-134, wherein the epitope is the hepatitis B virus epitope FLPSDFFPSV (SEQ ID NO:238).

Aspect 138. The method of any of any one of aspects 108-115 and 117-125, wherein the epitope is the hepatitis B virus epitope FLPSDFFPSV (SEQ ID NO:238).

Aspect 139. The method of any one of aspects 108-115 and 117-125, wherein the epitope is a hepatitis B virus epitope selected from the group consisting of: FLPSDFFPSV (SEQ ID NO:238), GLSRYVARLG (SEQ ID NO:239), KLHLYSHPI (SEQ ID NO:240), FLLSLGIHL (SEQ ID NO:241), ALMPLYACI (SEQ ID NO:242), SLYADSPSV (SEQ ID NO:243), STLPETTVV (SEQ ID NO:314), LIMPARFYPK (SEQ ID NO:315), AIMPARFYPK (SEQ ID NO:316), YVNVNMGLK (SEQ ID NO:317), PLGFFPDH (SEQ ID NO:318), MQWNSTALHQALQDP (SEQ ID NO:319), LLDPRVRGL (SEQ ID NO:320), SILSKTGDPV (SEQ ID NO:321), VLQAGFFLL (SEQ ID NO:322), FLLTRILTI (SEQ ID NO:323), FLGGTPVCL (SEQ ID NO:324), LLCLIFLLV (SEQ ID NO:325), LVLLDYQGML (SEQ ID NO:326), LLDYQGMLPV (SEQ ID NO:327), IPIPSSWAF (SEQ ID NO:328), WLSLLVPFV (SEQ ID NO:329), GLSPTVWLSV (SEQ ID NO:330), SIVSPFIPLL (SEQ ID NO:331), ILSPFLPLL (SEQ ID NO:332), ATVELLSFLPSDFFPSV (SEQ ID NO:333), LPSDFFPSV (SEQ ID NO:334), CLTFGRETV (SEQ ID NO:335), VLEYLVSFGV (SEQ ID NO:336), EYLVSFGVW (SEQ ID NO:337), ILSTLPETTV (SEQ ID NO:338), STLPETTVVRR (SEQ ID NO:339), NVSIPWTHK (SEQ ID NO:340), KVGNFTGLY (SEQ ID NO:341), GLYSSTVPV (SEQ ID NO:342), TLWKAGILYK (SEQ ID NO:343), TPARVTGGVF (SEQ ID NO:344), LVVDFSQFSR (SEQ ID NO:345), GLSRYVARL (SEQ ID NO:346), SIACSVVRR (SEQ ID NO:347), YMDDVVLGA (SEQ ID NO:348), ALMPLYACI (SEQ ID NO:242), QAFTFSPTYK (SEQ ID NO:349), KYTSFPWLL (SEQ ID NO:350), ILRGTSFVYV (SEQ ID NO:351), HLSLRGLFV (SEQ ID NO:352), VLHKRTLGL (SEQ ID NO:353), GLSAMSTTDL (SEQ ID NO:354), CLFKDWEEL (SEQ ID NO:355), and VLGGCRHKL (SEQ ID NO:356).

Aspect 140. The multimeric T-cell modulatory polypeptide of any of aspects 1-49 and 98-107, and 125-134, wherein the epitope is a hepatitis B virus epitope selected from the group consisting of FLPSDFFPSV (SEQ ID NO:238), GLSRYVARLG (SEQ ID NO:239), KLHLYSHPI (SEQ ID NO:240), FLLSLGIHL (SEQ ID NO:241), ALMPLYACI (SEQ ID NO:242), SLYADSPSV (SEQ ID NO:243), STLPETTVV (SEQ ID NO:314), LIMPARFYPK (SEQ ID NO:315), AIMPARFYPK (SEQ ID NO:316), YVNVNMGLK (SEQ ID NO:317), PLGFFPDH (SEQ ID NO:318), MQWNSTALHQALQDP (SEQ ID NO:319), LLDPRVRGL (SEQ ID NO:320), SILSKTGDPV (SEQ ID NO:321), VLQAGFFLL (SEQ ID NO:322), FLLTRILTI (SEQ ID NO:323), FLGGTPVCL (SEQ ID NO:324), LLCLIFLLV (SEQ ID NO:325), LVLLDYQGML (SEQ ID NO:326), LLDYQGMLPV (SEQ ID NO:327), IPIPSSWAF (SEQ ID NO:328), WLSLLVPFV (SEQ ID NO:329), GLSPTVWLSV (SEQ ID NO:330), SIVSPFIPLL (SEQ ID NO:331), ILSPFLPLL (SEQ ID NO:332), ATVELLSFLPSDFFPSV (SEQ ID NO:333), LPSDFFPSV (SEQ ID NO:334), CLTFGRETV (SEQ ID NO:335), VLEYLVSFGV (SEQ ID NO:336), EYLVSFGVW (SEQ ID NO:337), ILSTLPETTV (SEQ ID NO:338), STLPETTVVRR (SEQ ID NO:339), NVSIPWTHK (SEQ ID NO:340), KVGNFTGLY (SEQ ID NO:341), GLYSSTVPV (SEQ ID NO:342), TLWKAGILYK (SEQ ID NO:343), TPARVTGGVF (SEQ ID NO:344), LVVDFSQFSR (SEQ ID NO:345), GLSRYVARL (SEQ ID NO:346), SIACSVVRR (SEQ ID NO:347), YMDDVVLGA (SEQ ID NO:348), ALMPLYACI (SEQ ID NO:242), QAFTFSPTYK (SEQ ID NO:349), KYTSFPWLL (SEQ ID NO:350), ILRGTSFVYV (SEQ ID NO:351), HLSLRGLFV (SEQ ID NO:352), VLHKRTLGL (SEQ ID NO:353), GLSAMSTTDL (SEQ ID NO:354), CLFKDWEEL (SEQ ID NO:355), and VLGGCRHKL (SEQ ID NO:356).

Aspects Set B

Aspects, including embodiments, of the present subject matter described above may be beneficial alone or in combination, with one or more other aspects or embodiments. Without limiting the foregoing description, certain non-limiting aspects of the disclosure numbered 1-148 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspect 1. A variant IL-2 polypeptide comprising an amino acid sequence having at least 85% amino acid sequence identity to set forth in SEQ ID NO:15, wherein the variant IL-2 polypeptide has one or more amino acid substitutions relative to set forth in SEQ ID NO:15, and wherein the variant IL-2 polypeptide exhibits reduced binding affinity to an IL-2 receptor (IL2R) comprising alpha, beta, and gamma polypeptides having amino acid sequences set forth in SEQ ID NOs:16, 17, and 18, respectively, compared to the binding affinity of the IL-2 amino acid sequence set forth in one of SEQ ID NO:15 for the IL2R.

Aspect 2. The variant IL2 polypeptide of aspect 1, wherein the variant comprises a substitution of one or more of E15, H16, D20, F42, Y45, and Q126.

Aspect 3. The variant IL2 polypeptide of aspect 1 or aspect 2, wherein the variant immunomodulatory polypeptide exhibits from less than 10% to less than 50% of the binding affinity exhibited by the IL2 amino acid sequence set forth in SEQ ID NO:15 for the IL2R.

Aspect 4. The variant IL2 polypeptide of any one of aspects 1-3, wherein the variant comprises substitutions of F42 with Ala, Gly, Val, Ile, or Leu.

Aspect 5. The variant IL2 polypeptide of any one of aspects 1-3, wherein the variant comprises substitutions of F42 and D20, or substitutions of F42 and H16.

Aspect 6. The variant IL2 polypeptide of any one of aspects 1-3, wherein the variant comprises substitutions of F42, D20, and Y45; or where the variant comprises substitutions of F42, H16, and Q126.

Aspect 7. A multimeric polypeptide comprising: a) a first polypeptide comprising, in order from N-terminus to C-terminus: i) an epitope; ii) a first major histocompatibility complex (MHC) polypeptide; and b) a second polypeptide comprising, in order from N-terminus to C-terminus: i) a second MHC polypeptide; and ii) optionally an immunoglobulin (Ig) Fc polypeptide or a non-Ig scaffold, wherein the multimeric polypeptide comprises one or more immunomodulatory domains, wherein the one or more immunomodulatory domain is: A) at the C-terminus of the first polypeptide; B) at the N-terminus of the second polypeptide; C) at the C-terminus of the second polypeptide; or D) at the C-terminus of the first polypeptide and at the N-terminus of the second polypeptide, and wherein at least one of the immunomodulatory domains is a variant of a naturally occurring costimulatory protein, and wherein the variant exhibits a reduced affinity for its counterpart costimulatory protein as compared to the affinity of the naturally occurring costimulatory protein for the counterpart costimulatory protein.

Aspect 8. A multimeric polypeptide comprising: a) a first polypeptide comprising, in order from N-terminus to C-terminus: i) an epitope; ii) a first major histocompatibility complex (MHC) polypeptide; and b) a second polypeptide comprising, in order from N-terminus to C-terminus: i) a second MHC polypeptide; and ii) optionally an immunoglobulin (Ig) Fc polypeptide or a non-Ig scaffold, wherein the multimeric polypeptide comprises one or more immunomodulatory domains, wherein the one or more immunomodulatory domain is: A) at the C-terminus of the first polypeptide; B) at the N-terminus of the second polypeptide; C) at the C-terminus of the second polypeptide; or D) at the C-terminus of the first polypeptide and at the N-terminus of the second polypeptide, wherein at least one of the one or more immunomodulatory domains is a variant IL2 polypeptide of any one of aspects 1-6, and wherein the multimeric polypeptide exhibits reduced binding affinity to an IL-2 receptor (IL2R) comprising alpha, beta, and gamma polypeptides having amino acid sequences set forth in SEQ ID NOs:16, 17, and 18, respectively, compared to the binding affinity of a control multimeric polypeptide comprising the IL2 amino acid sequence set forth in SEQ ID NO:15 for the IL2R polypeptide.

Aspect 9. The multimeric polypeptide of aspect 8, wherein: a) the first polypeptide comprises, in order from N-terminus to C-terminus: i) the epitope; ii) the first MHC polypeptide; and iii) the variant IL2 polypeptide; and b) the second polypeptide comprises, in order from N-terminus to C-terminus: i) the second MHC polypeptide; and ii) the Ig Fc polypeptide.

Aspect 10. The multimeric polypeptide of aspect 8, wherein: a) the first polypeptide comprises, in order from N-terminus to C-terminus: i) the epitope; and ii) the first MHC polypeptide; and b) the second polypeptide comprises, in order from N-terminus to C-terminus: i) the variant IL2 polypeptide; ii) the second MHC polypeptide; and iii) the Ig Fc polypeptide.

Aspect 11. The multimeric polypeptide of aspect 8, wherein: a) the first polypeptide comprises, in order from N-terminus to C-terminus: i) the epitope; and ii) the first MHC polypeptide; and b) the second polypeptide comprises, in order from N-terminus to C-terminus: i) the second MHC polypeptide; and ii) the variant IL2 polypeptide.

Aspect 12. The multimeric polypeptide of aspect 8, wherein: a) the first polypeptide comprises, in order from N-terminus to C-terminus: i) the epitope; and ii) the first MHC polypeptide; and b) second polypeptide comprising, in order from N-terminus to C-terminus: i) the variant IL2 polypeptide; and ii) the second MHC polypeptide.

Aspect 13. The multimeric polypeptide of aspect 8, wherein: a) the first polypeptide comprises, in order from N-terminus to C-terminus: i) the epitope; ii) the first MHC polypeptide; and iii) the variant IL2 polypeptide; and b) the second polypeptide comprises the second MHC polypeptide.

Aspect 14. The multimeric polypeptide of aspect 7 or 8, wherein the non-Ig scaffold is an XTEN polypeptide, a transferrin polypeptide, an elastin-like polypeptide, a silk-like polypeptide, or a silk-elastin-like polypeptide.

Aspect 15. The multimeric polypeptide of any one of aspects 7-14, wherein the first MHC polypeptide is a β2-microglobulin polypeptide; and wherein the second MHC polypeptide is an MHC class I heavy chain polypeptide.

Aspect 16. The multimeric polypeptide of aspect 15, wherein the β2-microglobulin polypeptide comprises an amino acid sequence having at least 85% amino acid sequence identity to one of the amino acid sequences set forth in FIG. 7.

Aspect 17. The multimeric polypeptide of aspect 15, wherein the MHC class I heavy chain polypeptide is an HLA-A, an HLA-B, or an HLA-C heavy chain.

Aspect 18. The multimeric polypeptide of aspect 15, wherein the MHC class I heavy chain polypeptide comprises an amino acid sequence having at least 85% amino acid sequence identity to the amino acid sequence set forth in one of FIG. 6A-6C, or having at least 85% amino acid sequence identity to the amino acid sequence set forth in any one of FIG. 8A-8K.

Aspect 19. The multimeric polypeptide of aspect 30, wherein the MHC class I heavy chain polypeptide comprises an amino acid sequence having at least 85% amino acid sequence identity to the amino acid sequence set forth in one of: a) FIG. 8A; b) FIG. 8B, where amino acid 84 is Ala, and where amino acid 236 is Cys; c) FIG. 8C, where amino acid 84 is Cys, and where amino acid 139 is Cys; d) FIG. 8D; e) FIG. 8E, where amino acid 84 is Ala, and where amino acid 236 is Cys; f) FIG. 8F; g) FIG. 8G, where amino acid 84 is Ala, and where amino acid 236 is Cys; h) FIG. 8H, where amino acid 84 is Cys, and where amino acid 139 is Cys; i) FIG. 8I; j) FIG. 8J, where amino acid 84 is Ala, and where amino acid 236 is Cys; and k) FIG. 8K, where amino acid 84 is Cys, and where amino acid 139 is Cys.

Aspect 20. The multimeric polypeptide of any one of aspects 7-14, wherein the first MHC polypeptide is an MHC Class II alpha chain polypeptide; and wherein the second MHC polypeptide is an MHC class II beta chain polypeptide.

Aspect 21. The multimeric polypeptide of any one of aspects 7-20, wherein the epitope is a T-cell epitope.

Aspect 22. The multimeric polypeptide of any one of aspects 7-13 and 15-21, wherein multimeric polypeptide comprises an Fc polypeptide, and wherein the Ig Fc polypeptide is an IgG1 Fc polypeptide, an IgG2 Fc polypeptide, an IgG3 Fc polypeptide, an IgG4 Fc polypeptide, an IgA Fc polypeptide, or an IgM Fc polypeptide.

Aspect 23. The multimeric polypeptide of aspect 22, wherein the Ig Fc polypeptide comprises an amino acid sequence having at least 85% amino acid sequence identity to an amino acid sequence depicted in FIG. 5A-5C.

Aspect 24. The multimeric polypeptide of any one of aspects 7-23, wherein the first polypeptide and the second polypeptide are non-covalently associated.

Aspect 25. The multimeric polypeptide of any one of aspects 7-23, wherein the first polypeptide and the second polypeptide are covalently linked to one another.

Aspect 26. The multimeric polypeptide of aspect 25, wherein the covalent linkage is via a disulfide bond.

Aspect 27. The multimeric polypeptide of aspect 26, wherein the first MHC polypeptide or a linker between the epitope and the first MHC polypeptide comprises an amino acid substitution to provide a first Cys residue, and the second MHC polypeptide comprises an amino acid substitution to provide a second Cys residue, and wherein the disulfide linkage is between the first and the second Cys residues.

Aspect 28. The multimeric polypeptide of any one of aspects 7-27, comprising a linker interposed between the epitope and the first MHC polypeptide.

Aspect 29. The multimeric polypeptide of any one of aspects 7-27, comprising a linker interposed between the MHC polypeptide and the immunomodulatory polypeptide.

Aspect 30. The multimeric polypeptide of any one of aspects 7-29, comprising 2 variant IL2 polypeptides.

Aspect 31. The multimeric polypeptide of any one of aspects 7-29, comprising 3 variant IL2 polypeptides.

Aspect 32. The multimeric polypeptide of aspect 30 or aspect 31, wherein the 2 or 3 variant IL2 polypeptides are in tandem, and wherein the multimeric polypeptide comprises a linker between the variant IL2 polypeptides.

Aspect 33. The multimeric polypeptide of any one of aspects 8-29, wherein the variant IL2 comprises a substitution of one or more of E15, H16, D20, F42, Y45, and Q126.

Aspect 34. The multimeric polypeptide of any one of aspects 8-29, wherein the variant IL2 comprises a substitution of F42 with Ala, Gly, Val, Ile, or Leu.

Aspect 35. The multimeric polypeptide of aspect 34, wherein the variant IL2 comprises substitutions of F42 and D20, or substitutions of F42 and H16.

Aspect 36. The multimeric polypeptide of aspect 34, wherein the variant IL2 comprises substitutions of F42, D20, and Y45, or substitutions of F42, H16, and Q126.

Aspect 37. The multimeric polypeptide of any one of aspects 7-36, wherein the epitope is a peptide of from about 4 amino acids to 20 amino acids in length.

Aspect 38. The multimeric polypeptide of any one of aspects 7-37, wherein the epitope is a cancer epitope.

Aspect 39. The multimeric polypeptide of any one of aspects 7-37, wherein the epitope is a hepatitis B virus (HBV) epitope.

Aspect 40. The multimeric polypeptide of aspect 39, wherein the HBV epitope is an HBV peptide epitope derived from HBV polymerase, HBV envelope, HBV precore, or HBV X-protein.

Aspect 41. A nucleic acid comprising a nucleotide sequence encoding a recombinant polypeptide, i) wherein the recombinant polypeptide comprises, in order from N-terminus to C-terminus: a) an epitope; b) a first major histocompatibility complex (MHC) polypeptide; c) an immunomodulatory polypeptide; d) a proteolytically cleavable linker or a ribosome skipping signal; e) a second MHC polypeptide; and f) an immunoglobulin (Ig) Fc polypeptide; wherein the immunomodulatory polypeptide is a variant of a naturally occurring costimulatory protein, and wherein the variant exhibits a reduced affinity for its counterpart costimulatory protein as compared to the affinity of the naturally occurring costimulatory protein for the counterpart costimulatory protein; or ii) wherein the recombinant polypeptide comprises, in order from N-terminus to C-terminus: a) an epitope; b) a first MHC polypeptide; c) a proteolytically cleavable linker or a ribosome skipping signal; d) an immunomodulatory polypeptide e) a second MHC polypeptide; and f) an Ig Fc polypeptide, wherein the immunomodulatory polypeptide is a variant of a naturally occurring costimulatory protein, and wherein the variant exhibits a reduced affinity for its counterpart costimulatory protein as compared to the affinity of the naturally occurring costimulatory protein for the counterpart costimulatory protein.

Aspect 42. A nucleic acid comprising a nucleotide sequence encoding a recombinant polypeptide, i) wherein the recombinant polypeptide comprises, in order from N-terminus to C-terminus: a) an epitope; b) a first major histocompatibility complex (MHC) polypeptide; c) an immunomodulatory polypeptide; d) a proteolytically cleavable linker or a ribosome skipping signal; e) a second MHC polypeptide; and f) an immunoglobulin (Ig) Fc polypeptide; wherein the immunomodulatory polypeptide is a variant immunomodulatory polypeptide of any one of aspects 1-6; or ii) wherein the recombinant polypeptide comprises, in order from N-terminus to C-terminus: a) an epitope; b) a first MHC polypeptide; c) a proteolytically cleavable linker or a ribosome skipping signal; d) an immunomodulatory polypeptide; e) a second MHC polypeptide; and f) an Ig Fc polypeptide, wherein the immunomodulatory polypeptide is a variant immunomodulatory polypeptide of any one of aspects 1-6.

Aspect 43. The nucleic acid of aspect 41 or 42, wherein the first MHC polypeptide is a β2-microglobulin polypeptide; and wherein the second MHC polypeptide is an MHC class heavy chain polypeptide.

Aspect 44. The nucleic acid of aspect 43, wherein the β2-microglobulin polypeptide comprises an amino acid sequence having at least 85% amino acid sequence identity to one of the amino acid sequences set forth in FIG. 7.

Aspect 45. The nucleic acid of aspect 43, wherein the MHC class I heavy chain polypeptide is an HLA-A, HLA-B, or HLA-C heavy chain.

Aspect 46. The nucleic acid of aspect 45, wherein the MHC class I heavy chain polypeptide comprises an amino acid sequence having at least 85% amino acid sequence identity to the amino acid sequence set forth in any one of FIG. 6A-6C or having at least 85% amino acid sequence identity to the amino acid sequence set forth in any one of FIG. 8A-8K.

Aspect 47. The nucleic acid of aspect 41 or 42, wherein the first MHC polypeptide is an MHC Class II alpha chain polypeptide; and wherein the second MHC polypeptide is an MHC class II beta chain polypeptide.

Aspect 48. The nucleic acid of any one of aspects 41-47, wherein the epitope is a T-cell epitope, optionally wherein the epitope is a cancer epitope or an HBV epitope.

Aspect 49. The nucleic acid of any one of aspects 41-47, wherein the Ig Fc polypeptide is an IgG1 Fc polypeptide, an IgG2 Fc polypeptide, an IgG3 Fc polypeptide, an IgG4 Fc polypeptide, an IgA Fc polypeptide, or an IgM Fc polypeptide.

Aspect 50. The nucleic acid of aspect 49, wherein the Ig Fc polypeptide comprises an amino acid sequence having at least 85% amino acid sequence identity to an amino acid sequence depicted in FIGS. 5A-5C.

Aspect 51. The nucleic acid of any one of aspects 42-50, wherein the variant IL2 immunomodulatory polypeptide comprises a substitution of one or more of E15, H16, D20, F42, Y45, and Q126.

Aspect 52. The nucleic acid of any one of aspects 41-51, wherein the multimeric polypeptide comprises a second immunomodulatory polypeptide selected from a CD7, CD30L, CD40, CD70, CD83, HLA-G, MICA, MICB, HVEM, lymphotoxin beta receptor, 3/TR6, ILT3, ILT4, and HVEM.

Aspect 53. The nucleic acid of any one of aspects 41-52, wherein the proteolytically cleavable linker or ribosome skipping signal comprises an amino acid sequence selected from: a) LEVLFQGP (SEQ ID NO:44); b) ENLYTQS (SEQ ID NO:45); c) a furin cleavage site; d) LVPR (SEQ ID NO:47); e) GSGATNFSLLKQAGDVEENPGP (SEQ ID NO:48); f) GSGEGRGSLLTCGDVEENPGP (SEQ ID NO://); g) GSGQCTNYALLKLAGDVESNPGP (SEQ ID NO://); and h) GSGVKQTLNFDLLKLAGDVESNPGP (SEQ ID NO://).

Aspect 54. The nucleic acid of any one of aspect 41-53, wherein the recombinant polypeptide comprises, in order from N-terminus to C-terminus: a) a first leader peptide; b) the epitope; c) the first MHC polypeptide; d) the immunomodulatory polypeptide; e) the proteolytically cleavable linker or ribosome skipping signal; f) a second leader peptide; g) the second MHC polypeptide; and h) the immunoglobulin (Ig) Fc polypeptide.

Aspect 55. The nucleic acid of aspect 54, wherein the first leader peptide and the second leader peptide is a β2-M leader peptide.

Aspect 56. The nucleic acid of any one of aspects 41-55, wherein the nucleotide sequence is operably linked to a transcriptional control element.

Aspect 57. The nucleic acid of aspect 56, wherein the transcriptional control element is a promoter that is functional in a eukaryotic cell.

Aspect 58. The nucleic acid of any one of aspects 41-57, wherein the first MHC polypeptide or a linker between the epitope and the first MHC polypeptide comprises an amino acid substitution to provide a first Cys residue, and the second MHC polypeptide comprises an amino acid substitution to provide a second Cys residue, and wherein the first and the second Cys residues provide for a disulfide linkage between the first MHC polypeptide and the second MHC polypeptide.

Aspect 59. A recombinant expression vector comprising the nucleic acid of any one of aspects 41-58, wherein the vector is optionally a viral vector.

Aspect 60. A host cell genetically modified with the recombinant expression vector of aspect 59.

Aspect 61. The host cell of aspect 60, wherein the host cell is in vitro and wherein the host cell is optionally genetically modified such that the cell does not produce an endogenous MHC β2-microglobulin polypeptide.

Aspect 62. A composition comprising: a) a first nucleic acid comprising a nucleotide sequence encoding a first polypeptide comprising, in order from N-terminus to C-terminus: i) an epitope; ii) a first MHC polypeptide; and iii) an immunomodulatory domain, wherein the immunomodulatory polypeptide is a variant of a naturally occurring costimulatory protein, and wherein the variant exhibits a reduced affinity for its counterpart costimulatory protein as compared to the affinity of the naturally occurring costimulatory protein for the counterpart costimulatory protein; and b) a first nucleic acid comprising a nucleotide sequence encoding a second polypeptide comprising, in order from N-terminus to C-terminus: i) a second MHC polypeptide; and ii) an Ig Fc polypeptide.

Aspect 63. A composition comprising: a) a first nucleic acid comprising a nucleotide sequence encoding a first polypeptide comprising, in order from N-terminus to C-terminus: i) an epitope; and ii) a first MHC polypeptide; and b) a first nucleic acid comprising a nucleotide sequence encoding a second polypeptide comprising, in order from N-terminus to C-terminus: i) an immunomodulatory domain, wherein the immunomodulatory domain is a variant of a naturally occurring costimulatory protein, and wherein the variant exhibits a reduced affinity for its counterpart costimulatory protein as compared to the affinity of the naturally occurring costimulatory protein for its counterpart costimulatory protein; ii) a second MHC polypeptide; and iii) an Ig Fc polypeptide.

Aspect 64. A composition comprising: a) a first nucleic acid comprising a nucleotide sequence encoding a first polypeptide comprising, in order from N-terminus to C-terminus: i) an epitope; ii) a first MHC polypeptide; and iii) an immunomodulatory domain, wherein the immunomodulatory domain is a variant IL2 polypeptide of any one of aspects 1-6; and b) a first nucleic acid comprising a nucleotide sequence encoding a second polypeptide comprising, in order from N-terminus to C-terminus: i) a second MHC polypeptide; and ii) an Ig Fc polypeptide.

Aspect 65. A composition comprising: a) a first nucleic acid comprising a nucleotide sequence encoding a first polypeptide comprising, in order from N-terminus to C-terminus: i) an epitope; and ii) a first MHC polypeptide; and b) a first nucleic acid comprising a nucleotide sequence encoding a second polypeptide comprising, in order from N-terminus to C-terminus: i) an immunomodulatory domain, wherein the immunomodulatory domain is a variant IL2 polypeptide of any one of aspects 1-6; ii) a second MHC polypeptide; and iii) an Ig Fc polypeptide.

Aspect 66. The composition of any one of aspects 62-65, wherein the first and/or the second nucleic acid is present in a recombinant expression vector.

Aspect 67. A host cell genetically modified with the composition of any one of aspects 62-66.

Aspect 68. A method of producing the multimeric polypeptide of any one of aspects 7-40, the method comprising: a) culturing the host cell of any one of aspects 60, 61, and 67 in vitro in a culture medium under conditions such that the host cell synthesizes the multimeric polypeptide; and b)

isolating the multimeric polypeptide from the host cell and/or from the culture medium.

Aspect 69. The method of aspect 68, wherein the second polypeptide comprises an affinity tag, and wherein said isolating comprises contacting the multimeric polypeptide produced by the cell with a binding partner for the affinity tag, wherein the binding partner is immobilized, thereby immobilizing the multimeric polypeptide.

Aspect 70. The method of aspect 69, comprising eluting the immobilized multimeric polypeptide.

Aspect 71. A method of selectively activating an epitope-specific T cell, the method comprising contacting the T cell with the multimeric polypeptide of any one of aspects 7-40, wherein said contacting selectively activates the epitope-specific T cell.

Aspect 72. The method of aspect 71, wherein said contacting is in vitro.

Aspect 73. The method of aspect 71, wherein said contacting is in vivo.

Aspect 74. The method of aspect 71, wherein the epitope is a cancer-associated epitope, and wherein said administering selectively increases the activity of a T cell specific for the cancer-associate epitope.

Aspect 75. A method of treating cancer in an individual, the method comprising administering to the individual an effective amount of: a) the multimeric polypeptide of any one of aspects 7-40; or b) one or more recombinant expression vectors comprising nucleotide sequences encoding the multimeric polypeptide of any one of aspects 7-40; or c) one or more mRNAs comprising nucleotide sequences encoding the multimeric polypeptide of any one of aspects 7-40, wherein the epitope is a cancer-associated epitope, and wherein said administering effective to selectively activate a cancer epitope-specific T cell in an individual.

Aspect 76. The method of aspect 75, wherein said administering is subcutaneous.

Aspect 77. The method of aspect 75, wherein said administering is intravenous.

Aspect 78. The method of aspect 75, wherein said administering is peritumoral.

Aspect 79. The method of aspect 75, wherein said administering is systemic.

Aspect 80. The method of aspect 75, wherein said administering is distal to a treatment site.

Aspect 81. The method of aspect 75, wherein said administering is local.

Aspect 82. The method of aspect 75, wherein said administering is at or near a treatment site.

Aspect 83. A composition comprising: a) the multimeric polypeptide of any one of aspects 7-40; and b) a pharmaceutically acceptable excipient.

Aspect 84. A composition comprising: a) the nucleic acid of any one of aspects 41-58 or the recombinant expression vector of aspect 59; and b) a pharmaceutically acceptable excipient.

Aspect 85. A multimeric polypeptide comprising: a) a first polypeptide comprising, in order from N-terminus to C-terminus: i) an epitope; ii) a β2-microglobulin (β2M) polypeptide comprising an R12C substitution; and b) a second polypeptide comprising, in order from N-terminus to C-terminus: i) a variant of a naturally occurring costimulatory protein, and wherein the variant exhibits a reduced affinity for its counterpart costimulatory protein on a T cell as compared to the affinity of the naturally occurring costimulatory protein for the counterpart costimulatory protein, which variant may optionally be a variant IL-2 polypeptide of any one of aspects 1-6; ii) a major histocompatibility complex (MHC) heavy chain polypeptide comprising an A*0201 amino acid sequence with Y84A and A236C substitutions; and iii) an IgG1 Fc polypeptide comprising one or more amino acid substitutions selected from N297A, L234A, L235A, L234F, L235E, and P331S.

Aspect 86. The multimeric polypeptide of aspect 85, wherein the IgG1 Fc polypeptide comprises an N297A substitution.

Aspect 87. The multimeric polypeptide of aspect 85, wherein the IgG1 Fc polypeptide comprises an L234A substitution and an L235A substitution.

Aspect 88. The multimeric polypeptide of aspect 85, wherein the IgG1 Fc polypeptide comprises an L234F substitution and an L235E substitution.

Aspect 89. The multimeric polypeptide of aspect 85, wherein the IgG1 Fc polypeptide comprises an L234F substitution, an L235E substitution, and a P331S substitution.

Aspect 90. The multimeric polypeptide of any one of aspects 85-89, wherein the second polypeptide comprises two copies of the variant IL-2 polypeptide.

Aspect 91. The multimeric polypeptide of any one of aspects 85-90, wherein the first polypeptide comprises a peptide linker between the epitope and the β2M polypeptide.

Aspect 92. The multimeric polypeptide of any one of aspects 85-91, wherein the second polypeptide comprises a peptide linker between one or more of: a) a first copy of the variant IL-2 polypeptide and a second copy of the variant IL-2 polypeptide; b) the variant IL-2 polypeptide and the MHC heavy chain polypeptide; and c) between the MHC heavy chain polypeptide and the IgG1 Fc polypeptide.

Aspect 93. The multimeric polypeptide of aspect 91 or aspect 92, wherein the peptide linker is selected from (GGGGS)$_3$, (GGGGS)$_4$, and AAAGG.

Aspect 94. A multimeric polypeptide comprising: a) a first polypeptide comprising, in order from N-terminus to C-terminus: i) an epitope; ii) a β2-microglobulin polypeptide comprising the amino acid sequence comprising an R12C substitution; and b) a second polypeptide comprising, in order from N-terminus to C-terminus: i) a variant IL-2 polypeptide comprising H16A and F42A substitutions relative to SEQ ID NO:15; ii) a major histocompatibility complex (MHC) heavy chain polypeptide comprising an A*0201 amino acid sequence with Y84A and A236C substitutions; and iii) an IgG1 Fc polypeptide comprising one or more amino acid substitutions selected from N297A, L234A, L235A, L234F, L235E, and P331S.

Aspect 95. The multimeric polypeptide of aspect 94, wherein the IgG1 Fc polypeptide comprises an N297A substitution.

Aspect 96. The multimeric polypeptide of aspect 94, wherein the IgG1 Fc polypeptide comprises an L234A substitution and an L235A substitution.

Aspect 97. The multimeric polypeptide of aspect 94, wherein the IgG1 Fc polypeptide comprises an L234F substitution and an L235E substitution.

Aspect 98. The multimeric polypeptide of aspect 94, wherein the IgG1 Fc polypeptide comprises an L234F substitution, an L235E substitution, and a P331S substitution.

Aspect 99. The multimeric polypeptide of any one of aspects 94-98, wherein the second polypeptide comprises two copies of the variant IL-2 polypeptide.

Aspect 100. The multimeric polypeptide of any one of aspects 94-99, wherein the first polypeptide comprises a peptide linker between the epitope and the β2M polypeptide.

Aspect 100. The multimeric polypeptide of any one of aspects 94-99, wherein the second polypeptide comprises a peptide linker between one or more of: a) a first copy of the variant IL-2 polypeptide and a second copy of the variant IL-2 polypeptide; b) the variant IL-2 polypeptide and the MHC heavy chain polypeptide; and c) the MHC heavy chain polypeptide and the IgG1 Fc polypeptide.

Aspect 102. The multimeric polypeptide of aspect 100 or aspect 101, wherein the peptide linker is selected from $(GGGGS)_3$, $(GGGGS)_4$, and AAAGG.

Aspect 103. A multimeric polypeptide comprising: a) a first polypeptide comprising, in order from N-terminus to C-terminus: i) an epitope comprising the amino acid sequence YMLDLQPETT (SEQ ID NO:13); ii) a β2-microglobulin polypeptide comprising an R12C substitution; and b) a second polypeptide comprising, in order from N-terminus to C-terminus: i) a variant IL-2 polypeptide comprising H16A and F42A substitutions relative to SEQ ID NO:15; ii) a major histocompatibility complex (MHC) heavy chain polypeptide comprising an A*0201 amino acid sequence with Y84A and A236C substitutions; and iii) an IgG1 Fc polypeptide comprising the amino acid sequence depicted in FIG. 5D, 5E, 5F, or 5G.

Aspect 104. The multimeric polypeptide of aspect 103, wherein the IgG1 Fc polypeptide comprises the amino acid sequence depicted in FIG. 5E.

Aspect 105. The multimeric polypeptide of aspect 103, wherein the IgG1 Fc polypeptide comprises the amino acid sequence depicted in FIG. 5F.

Aspect 106. The multimeric polypeptide of aspect 103, wherein the IgG1 Fc polypeptide comprises the amino acid sequence depicted in FIG. 5G.

Aspect 107. The multimeric polypeptide of any one of aspects 103-106, wherein the second polypeptide comprises two copies of the variant IL-2 polypeptide.

Aspect 108. The multimeric polypeptide of any one of aspects 103-107, wherein the first polypeptide comprises a peptide linker between the epitope and the β2M polypeptide.

Aspect 109. The multimeric polypeptide of any one of aspects 103-108, wherein the second polypeptide comprises a peptide linker between one or more of: a) a first copy of the variant IL-2 polypeptide and a second copy of the variant IL-2 polypeptide; b) the variant IL-2 polypeptide and the MHC heavy chain polypeptide; and c) the MHC heavy chain polypeptide and the IgG1 Fc polypeptide.

Aspect 110. The multimeric polypeptide of aspect 108 or aspects 109, wherein the peptide linker is selected from $(GGGGS)_3$, $(GGGGS)_4$, and AAAGG.

Aspect 111. A pharmaceutical composition comprising: a) a multimeric polypeptide according to any one of aspects 85-113; and b) a pharmaceutically acceptable excipient.

Aspect 112. One or more nucleic acids comprising nucleotide sequences encoding the first and/or the second polypeptide of the multimeric polypeptide according to any one of aspects 85-113.

Aspect 113. The one or more nucleic acids of aspect 115, wherein the nucleic acids are present in recombinant expression vectors.

Aspect 114. A method of selectively activating an epitope-specific T cell, the method comprising contacting the T cell with the multimeric polypeptide of any one of aspects 85-113, wherein said contacting selectively activates the epitope-specific T cell.

Aspect 115. The method of aspect 117, wherein said contacting is in vitro.

Aspect 116. The method of aspect 117, wherein said contacting is in vivo.

Aspect 117. A method comprising administering to an individual an effective amount of: a) the multimeric polypeptide of any one of aspects 85-110; or b) one or more recombinant expression vectors comprising nucleotide sequences encoding the multimeric polypeptide of any one of aspects 85-110; or c) one or more mRNAs comprising nucleotide sequences encoding the multimeric polypeptide of any one of aspects 85-110, wherein said administering induces a T cell response to epitope in the individual.

Aspect 118. The method of aspect 117, wherein said administering is subcutaneous.

Aspect 119. The method of aspect 117, wherein said administering is intravenous.

Aspect 120. The method of aspect 117, wherein said administering is systemic.

Aspect 121. The method of aspect 117, wherein said administering is intramuscular.

Aspect 122. The method of aspect 117, wherein said administering is distal to a treatment site.

Aspect 123. The method of aspect 117, wherein said administering is local.

Aspect 124. The method of aspect 117, wherein said administering is at or near a treatment site.

Aspect 125. A method of delivering a costimulatory polypeptide selectively to target T cell, the method comprising contacting a mixed population of T cells with a multimeric polypeptide of any one of aspects 7-40 and 85-110, wherein the mixed population of T cells comprises the target T cell and non-target T cells, wherein the target T cell is specific for the epitope present within the multimeric polypeptide, and wherein said contacting delivers the costimulatory polypeptide present within the multimeric polypeptide to the target T cell.

Aspect 126. A method of delivering IL-2 or a IL-2 variant selectively to a target T cell, the method comprising contacting a mixed population of T cells with the multimeric polypeptide of any one of aspects 8-40 and 85-110, wherein the mixed population of T cells comprises the target T cell and non-target T cells, wherein the target T cell is specific for the epitope present within the multimeric polypeptide, and wherein said contacting delivers the IL-2 or IL-2 variant present within the multimeric polypeptide to the target T cell.

Aspect 127. The method of aspect 125 or 126, wherein the population of T cells is in vitro.

Aspect 128. The method of aspect 125 or 126, wherein the population of T cells is in vivo in an individual.

Aspect 129. The method of aspect 128, comprising administering the multimeric polypeptide to the individual.

Aspect 130. The method of any one of aspects 125-129, wherein the target T cell is a regulatory T cell.

Aspect 131. The method of any one of aspects 125-129, wherein the target T cell is a cytotoxic T cell.

Aspect 132. The method of aspect 125 or 126, wherein the mixed population of T cells is an in vitro population of mixed T cells obtained from an individual, and wherein said contacting results in activation and/or proliferation of the target T cell, generating a population of activated and/or proliferated target T cells.

Aspect 133. The method of aspect 132, further comprising administering the population of activated and/or proliferated target T cells to the individual.

Aspect 134. A method of detecting, in a mixed population of T cells obtained from an individual, the presence of a target T cell that binds an epitope of interest, the method comprising: a) contacting in vitro the mixed population of T cells with the multimeric polypeptide of any one of aspects 7-40 and 85-110, wherein the multimeric polypeptide comprises the epitope of interest; and b) detecting activation and/or proliferation of T cells in response to said contacting, wherein activated and/or proliferated T cells indicates the presence of the target T cell.

Aspect 135. A method of modulating a T-cell response to a hepatitis B virus (HBV) antigen in an individual, the method comprising administering to the individual an effective amount of the multimeric polypeptide of aspect 39 or aspect 40.

Aspect 136. The method of aspect 135, wherein the individual has an acute HBV infection.

Aspect 137. The method of aspect 135, wherein the individual is an inactive HBV carrier.

Aspect 138. The method of aspect 135, wherein the individual has a chronic active HBV infection.

Aspect 139. The method of aspect 135, wherein the individual has liver cancer resulting from an HBV infection.

Aspect 140. The method of any one of aspects 135-139, wherein the individual has an HLA-A A11 heavy chain allele.

Aspect 141. A method of treating a hepatitis B virus (HBV) infection in an individual, the method comprising administering to the individual an effective amount of the T-cell modulatory multimeric polypeptide of aspect 39 or aspect 40.

Aspect 142. The method of aspect 141, wherein the individual has an acute HBV infection.

Aspect 143. The method of aspect 141 or 142, wherein the individual has an HLA-A A11 heavy chain allele.

Aspect 144. A method of treating liver cancer caused by a hepatitis B virus (HBV) infection in an individual, the method comprising administering to the individual an effective amount of the T-cell modulatory multimeric polypeptide of aspect 39 or aspect 40.

Aspect 145. The method of aspect 144, wherein the individual has an HLA-A A11 heavy chain allele.

Aspects Set C

Aspects, including embodiments, of the present subject matter described above may be beneficial alone or in combination, with one or more other aspects or embodiments. Without limiting the foregoing description, certain non-limiting aspects of the disclosure numbered 1-55 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspect 1. T-cell modulatory multimeric polypeptide comprising: at least one heterodimer comprising: a) a first polypeptide comprising: i) a hepatitis B virus (HBV) peptide epitope, wherein the HBV peptide has a length of at least 4 amino acids; and ii) first major histocompatibility complex (MHC) polypeptide; b) a second polypeptide comprising a second MHC polypeptide, and c) at least one immunomodulatory polypeptide, wherein the first and/or the second polypeptide comprises the immunomodulatory polypeptide.

Aspect 2. A T-cell modulatory multimeric polypeptide of aspect 1, wherein at least one of the one or more immunomodulatory domains is a variant immunomodulatory polypeptide that exhibits reduced affinity to a cognate co-immunomodulatory polypeptide compared to the affinity of a corresponding wild-type immunomodulatory polypeptide for the cognate co-immunomodulatory polypeptide, and wherein the epitope binds to a T-cell receptor (TCR) on a T cell with an affinity of at least $10^7$ M, such that: i) the T-cell modulatory multimeric polypeptide binds to a first T cell with an affinity that is at least 25% higher than the affinity with which the T-cell modulatory multimeric polypeptide binds a second T cell, wherein the first T cell expresses on its surface the cognate co-immunomodulatory polypeptide and a TCR that binds the epitope with an affinity of at least $10^{-7}$ M, and wherein the second T cell expresses on its surface the cognate co-immunomodulatory polypeptide but does not express on its surface a TCR that binds the epitope with an affinity of at least $10^{-7}$ M; and/or ii) the ratio of the binding affinity of a control T-cell modulatory multimeric polypeptide, wherein the control comprises a wild-type immunomodulatory polypeptide, to a cognate co-immunomodulatory polypeptide to the binding affinity of the T-cell modulatory multimeric polypeptide comprising a variant of the wild-type immunomodulatory polypeptide to the cognate co-immunomodulatory polypeptide, when measured by bio-layer interferometry, is in a range of from 1.5:1 to $10^6$:1.

Aspect 3. A T-cell modulatory multimeric polypeptide of aspect 2, wherein: a) the T-cell modulatory multimeric polypeptide binds to the first T cell with an affinity that is at least 50%, at least 2-fold, at least 5-fold, or at least 10-fold higher than the affinity with which it binds the second T cell; and/or b) the variant immunomodulatory polypeptide binds the co-immunomodulatory polypeptide with an affinity of from about $10^{-4}$ M to about $10^{-7}$ M, from about $10^{-4}$ M to about $10^{-6}$ M, from about $10^{-4}$ M to about $10^{-5}$ M; and/or c) wherein the ratio of the binding affinity of a control T-cell modulatory multimeric polypeptide, wherein the control comprises a wild-type immunomodulatory polypeptide, to a cognate co-immunomodulatory polypeptide to the binding affinity of the T-cell modulatory multimeric polypeptide comprising a variant of the wild-type immunomodulatory polypeptide to the cognate co-immunomodulatory polypeptide, when measured by bio-layer interferometry, is at least 10:1, at least 50:1, at least $10^2$:1, or at least $10^3$:1.

Aspect 4. A T-cell modulatory multimeric polypeptide of any one of aspects 1-3, wherein the first or the second polypeptide comprises an immunoglobulin (Ig) Fc polypeptide.

Aspect 5. A T-cell modulatory multimeric polypeptide of aspect 4, wherein the Ig Fc polypeptide is an IgG1 Fc polypeptide or an IgG4 Fc polypeptide.

Aspect 6. A T-cell modulatory multimeric polypeptide of aspect 5, wherein IgG1 Fc polypeptide comprises one or more amino acid substitutions selected from N297A, L234A, L235A, L234F, L235E, and P331S.

Aspect 7. A T-cell modulatory multimeric polypeptide of any one of aspects 1-6, wherein: a1) the first polypeptide comprises, in order from N-terminus to C-terminus: i) the HBV peptide epitope; ii) the first MHC polypeptide; and iii) at least one immunomodulatory polypeptide; and b1) the second polypeptide comprises, in order from N-terminus to C-terminus: i) the second MHC polypeptide; and ii) an immunoglobulin (Ig) Fc polypeptide; or a2) the first polypeptide comprises, in order from N-terminus to C-terminus: i) the HBV peptide epitope; and ii) the first MHC polypeptide; and b2) the second polypeptide comprises, in order from N-terminus to C-terminus: i) at least one immunomodulatory polypeptide; ii) the second MHC polypeptide; and iii) an Ig Fc polypeptide; or a3) the first polypeptide comprises, in order from N-terminus to C-terminus: i) the HBV peptide epitope; and ii) the first MHC polypeptide; and b3) the second polypeptide comprises, in order from N-terminus to C-terminus: i) the second MHC polypeptide; and ii) an Ig Fc polypeptide; and iii) at least one immunomodulatory polypeptide; or a4) the first polypeptide comprises, in order from N-terminus to C-terminus: i) the HBV peptide epitope; and ii) the first MHC polypeptide; and b4) the second polypeptide comprises, in order from N-terminus to C-terminus: i) the second MHC polypeptide; and ii) at least one immunomodulatory polypeptide; or a5) the first polypeptide comprises, in order from N-terminus to C-terminus: i) the HBV peptide epitope; and ii) the first MHC polypeptide; and b5) a second polypeptide comprises, in order from N-terminus to C-terminus: i) at least one immunomodulatory polypeptide; and ii) the second MHC polypeptide; or a6) the first polypeptide comprises, in order from N-terminus to C-terminus: i) the HBV peptide epitope; ii) the first MHC polypeptide; and iii) at least one immunomodulatory polypeptide; and b6) the second polypeptide comprises: i) the second MHC polypeptide.

Aspect 8. A T-cell modulatory multimeric polypeptide of any one of aspects 1-7, wherein the first polypeptide comprises a peptide linker between the HBV epitope and the first MHC polypeptide and/or wherein the second polypeptide comprises a peptide linker between the immunomodulatory polypeptide and the second MHC polypeptide.

Aspect 9. A T-cell modulatory multimeric polypeptide of aspect 8, wherein the peptide linker comprises the amino acid sequence (GGGGS)n, where n is an integer from 1 to 10.

Aspect 10. A T-cell modulatory multimeric polypeptide of any one of aspects 1-9, wherein the first MHC polypeptide is a β2-microglobulin polypeptide; and wherein the second MHC polypeptide is an MHC class I heavy chain polypeptide.

Aspect 11. A T-cell modulatory multimeric polypeptide of any one of aspects 1-10, wherein the at least one immunomodulatory polypeptide is selected from the group consisting of a cytokine, a 4-1BBL polypeptide, a B7-1 polypeptide; a B7-2 polypeptide, an ICOS-L polypeptide, an OX-40L polypeptide, a CD80 polypeptide, a CD86 polypeptide, a PD-L1 polypeptide, a FasL polypeptide, a PD-L2 polypeptide, and combinations thereof.

Aspect 12. A T-cell modulatory multimeric polypeptide of any one of aspects 1-11, wherein the at least one immunomodulatory polypeptide is an IL-2 polypeptide.

Aspect 13. A T-cell modulatory multimeric polypeptide of any one of aspects 1-12, wherein the multimeric polypeptide comprises at least two immunomodulatory polypeptides, and wherein at least two of the immunomodulatory polypeptides are the same or are different.

Aspect 14. A T-cell modulatory multimeric polypeptide of aspect 13, wherein the 2 or more immunomodulatory polypeptides are in tandem.

Aspect 15. A T-cell modulatory multimeric polypeptide of any one of aspects 1-14, wherein the first polypeptide and the second polypeptide are covalently linked to one another.

Aspect 16. A T-cell modulatory multimeric polypeptide of aspect 15, wherein the covalent linkage is via a disulfide bond.

Aspect 17. A T-cell modulatory multimeric polypeptide of any one of aspects 1-16, wherein the first MHC polypeptide or a linker between the epitope and the first MHC polypeptide comprises an amino acid substitution to provide a first Cys residue, wherein the second MHC polypeptide comprises an amino acid substitution to provide a second Cys residue, and wherein the disulfide linkage is between the first and the second Cys residues.

Aspect 18. A T-cell modulatory multimeric polypeptide of any one of aspects 1-17, wherein the HBV peptide epitope has a length of from about 4 amino acids to about 25 amino acids.

Aspect 19. A T-cell modulatory multimeric polypeptide of any one of aspects 1-18, wherein the HBV peptide epitope comprises an amino acid sequence selected from the group consisting of: FLPSDFFPSV, GLSRYVARLG, KLHLYSHPI, FLLSLGIHL, ALMPLYACI, SLYADSPSV, STLPETTVV, LIMPARFYPK, AIMPARFYPK, YVNVNMGLK, YVNVNMGLK, MQWNSTALHQALQDP, LLDPRVRGL, SILSKTGDPV, VLQAGFFLL, FLLTRILTI, FLGGTPVCL, LLCLIFLLV, LVLLDYQGML, LLDYQGMLPV, IPIPSSWAF, WLSLLVPFV, GLSPTVWLSV, SIVSPFIPLL, ILSPFLPLL, ATVELLSFLPSDFFPSV, LPSDFFPSV, CLTFGRETV, VLEYLVSFGV, EYLVSFGVW, ILSTLPETTV, STLPETTVVRR, NVSIPWTHK, KVGNFTGLY, GLYSSTVPV, TLWKAGILYK, TPARVTGGVF, LVVDFSQFSR, GLSRYVARL, SIACSVVRR, YMDDVVLGA, ALMPLYACI, ALMPLYACI, KYTSFPWLL, ILRGTSFVYV, HLSLRGLFV, VLHKRTLGL, GLSAMSTTDL, CLFKDWEEL, and VLGGCRHKL.

Aspect 20. A T-cell modulatory multimeric polypeptide of any one of aspects 1-19, wherein the first MHC polypeptide is a β2M polypeptide, and wherein the second MHC polypeptide is an HLA-A polypeptide.

Aspect 21. A T-cell modulatory multimeric polypeptide of any one of aspects 1-20, wherein the first or the second MHC polypeptide comprises: a) an amino acid sequence having at least 95% amino acid sequence identity to the HLA-A*0101, HLA-A*0201, HLA-A*0201, HLA-A*1101, HLA-A*2301, HLA-A*2402, HLA-A*2407, HLA-A*3303, or HLA-A*3401 amino acid sequence depicted in FIG. 26A; or b) an amino acid sequence having at least 95% amino acid sequence identity to the HLA-B*0702. HLA-B*0801, HLA-B*1502, HLA-B*3802, HLA-B*4001, HLA-B*4601, or HLA-B*5301 amino acid sequence depicted in FIG. 27A; or c) an amino acid sequence having at least 95% amino acid sequence identity to the HLA-C*0102, HLA-C*0303, HLA-C*0304, HLA-C*0401, HLA-C*0602, HLA-C*0701, HLA-C*0702, HLA-C*0801, or HLA-C*1502 depicted in FIG. 28A.

Aspect 22. A T-cell modulatory multimeric polypeptide of any one of aspects 1-20, wherein the first MHC polypeptide is a β2M polypeptide, and wherein the second MHC polypeptide comprises an amino acid sequence having at least 95% amino acid sequence identity to an HLA-A*2402 polypeptide.

Aspect 23. A T-cell modulatory multimeric polypeptide of any one of aspects 1-20, wherein the first MHC polypeptide is a β2M polypeptide, and wherein the second MHC polypeptide is an HLA-A*1101 polypeptide.

Aspect 24. A T-cell modulatory multimeric polypeptide of any one of aspects 1-20, wherein the first MHC polypeptide is a β2M polypeptide, and wherein the second MHC polypeptide comprises an amino acid sequence having at least 95% amino acid sequence identity to an HLA-A*3303 polypeptide.

Aspect 25. A T-cell modulatory multimeric polypeptide of any one of aspects 1-20, wherein the first MHC polypeptide is a β2M polypeptide, and wherein the second MHC polypeptide comprises an amino acid sequence having at least 95% amino acid sequence identity to an HLA-A*0201 polypeptide.

Aspect 26. A T-cell modulatory multimeric polypeptide of any one of aspects 21-25, wherein the MHC heavy chain polypeptide comprises a Cys at position 236.

Aspect 27. A T-cell modulatory multimeric polypeptide of any one of asppects 21-26, wherein the β2M polypeptide comprises a Cys at position 12.

Aspect 28. A T-cell modulatory multimeric polypeptide of any one of aspects 1-27, wherein the immunomodulatory polypeptide is a variant IL-2 polypeptide comprising: i) an H16A substitution and an F42A substation; or ii) an H16T substitution and an F42A substitution.

Aspect 29. A T-cell modulatory multimeric polypeptide of any one of aspects 4-25, wherein the multimeric polypeptide comprises a first and a second heterodimer, and wherein the first and second heterodimers are covalently bound by one or more disulfide bonds between the Ig Fc polypeptides of the first and second heterodimers.

Aspect 30. A nucleic acid comprising a nucleotide sequence encoding a first or second polypeptide according to any one of aspects 1-28, wherein the first or second polypeptide comprises at least one immunomodulatory domain.

Aspect 31. A recombinant expression vector comprising the nucleic acid of aspect 30.

Aspect 32. A method of selectively modulating the activity of T cell specific for a hepatitis B virus (HBV) epitope, the method comprising contacting the T cell with a T-cell modulatory multimeric polypeptide according to any one of aspects 1-29, wherein said contacting selectively modulates the activity of the HBV epitope-specific T cell.

Aspect 33. A method of treating a patient having a cancer, the method comprising administering to the patient an effective amount of a pharmaceutical composition comprising T-cell modulatory multimeric polypeptide according to any one of aspects 1-29.

Aspect 34. The method of aspect 33, wherein the cancer is hepatocellular carcinoma.

Aspect 35. The method of aspect 33 or aspect 34, wherein said administering is intramuscular.

Aspect 36. The method of aspect 33 or aspect 34, wherein said administering is intravenous.

Aspect 37. A method of modulating an immune response in an individual, the method comprising administering to the individual an effective amount of the T-cell modulatory multimeric polypeptide (TMMP) of any one of aspects 1-29 wherein said administering induces an epitope-specific T cell response (e.g., a T cell response specific for the HBV epitope present in the TMMP) and an epitope-non-specific T cell response, wherein the ratio of the epitope-specific T cell response to the epitope-non-specific T cell response is at least 2:1.

Aspect 38. The method of aspect 37, wherein the ratio of the epitope-specific T cell response to the epitope-non-specific T cell response is at least 5:1.

Aspect 39. The method of aspect 37, wherein the ratio of the epitope-specific T cell response to the epitope-non-specific T cell response is at least 10:1.

Aspect 40. The method of aspect 37, wherein the ratio of the epitope-specific T cell response to the epitope-non-specific T cell response is at least 25:1.

Aspect 41. The method of aspect 37, wherein the ratio of the epitope-specific T cell response to the epitope-non-specific T cell response is at least 50:1.

Aspect 42. The method of aspect 37, wherein the ratio of the epitope-specific T cell response to the epitope-non-specific T cell response is at least 100:1.

Aspect 43. The method of any one of aspects 37-42, wherein the individual is a human.

Aspect 44. The method of any one of aspects 37-43, wherein said modulating comprises increasing a cytotoxic T-cell response to a cancer cell (e.g., an HBV-expressing cancer cell).

Aspect 45. The method of any one of aspects 37-44, wherein said administering is intravenous, subcutaneous, intramuscular, systemic, intralymphatic, distal to a treatment site, local, or at or near a treatment site.

Aspect 47. The method of any one of aspects 37-45, wherein the epitope non-specific T-cell response is less than the epitope non-specific T-cell response that would be induced by a control T-cell modulatory multimeric polypeptide comprising a corresponding wild-type immunomodulatory polypeptide.

Aspect 48. A method of delivering a costimulatory (i.e., immunomodulatory) polypeptide selectively to target T cell, the method comprising contacting a mixed population of T cells with a T-cell modulatory multimeric polypeptide (TMMP) of any one of aspects 1-29, wherein the mixed population of T cells comprises the target T cell and non-target T cells, wherein the target T cell is specific for the epitope present within the TMMP (e.g., wherein the target T cell is specific for the HBV epitope present within the TMMP), and wherein said contacting delivers the one or more costimulatory polypeptides present within the TMMP to the target T cell.

Aspect 49. The method of aspect 48, wherein the population of T cells is in vitro.

Aspect 50. The method of aspect 48, wherein the population of T cells is in vivo in an individual.

Aspect 51. The method of aspect 48, comprising administering the multimeric polypeptide to the individual.

Aspect 52. The method of any one of aspects 48-51, wherein the target T cell is a cytotoxic T cell.

Aspect 53. The method of aspect 48, wherein the mixed population of T cells is an in vitro population of mixed T cells obtained from an individual, and wherein said contacting results in activation and/or proliferation of the target T cell, generating a population of activated and/or proliferated target T cells.

Aspect 54. The method of aspect 53, further comprising administering the population of activated and/or proliferated target T cells to the individual.

Aspect 55. A method of detecting, in a mixed population of T cells obtained from an individual, the presence of a target T cell that binds an HBV epitope of interest, the method comprising: a) contacting in vitro the mixed population of T cells with T-cell modulatory multimeric polypeptide (TMMP) of any one of aspects 1-29, wherein the TMMP comprises the HBV epitope of interest; and b) detecting activation and/or proliferation of T cells in response to said contacting, wherein activated and/or proliferated T cells indicates the presence of the target T cell.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (406 sequences)

SEQ ID NO: 1 - protein, 245 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPST

SEQ ID NO: 2 - protein, 219 aa, Homo sapiens
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKI

SEQ ID NO: 3 - protein, 268 aa, Homo sapiens
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 4 - protein, 208 aa, Homo sapiens [sequence omitted]

SEQ ID NO: 5 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 6 - protein, 123 aa, Homo sapiens
MLRLLLALNLFPSIQVTGNKILVKQSPMLVAYDNAVNLSWKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 7 - protein, 101 aa, Homo sapiens
MLRLLLALNLFPSIQVTGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 8 - protein, 224 aa, Homo sapiens
APLKIQAYFNETADLPCQFANSQNQSLSELVVFWQDQENLVLNEVYLGKEKFDSVHSKYMNRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 9 - protein, 110 aa, Homo sapiens
APLKIQAYFNETADLPCQFANSQNQSLSELVVFWQDQENLVLNEVYLGKEKFDSVHSKYMNRTSFDSDSWTLRLHNLQIKDKGLYQCIIHHKKPTGMIRIHQMNSELSVL

SEQ ID NO: 10 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 11 - protein, 174 aa, Homo sapiens
PAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 12 - protein, 175 aa, Homo sapiens
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 13 - protein, 167 aa, Homo sapiens
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPA

SEQ ID NO: 14 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 15 - protein, 133 aa, Homo sapiens [sequence omitted]

SEQ ID NO: 16 - protein, 251 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 17 - protein, 524 aa, Homo sapiens
VNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 18 - protein, 347 aa, Homo sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 19 - protein, 133 aa, Artificial sequence
  Synthetic polypeptide
  Misc_feature (42)..(42): any amino acid other than phenylalanine
APTSSSTKKTQLQLEHLLLDLQMILNGINNYKNPKLTRMLTXKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 20 - protein, 133 aa, Artificial sequence
  Synthetic polypeptide
  Misc_feature (20)..(20): any amino acid other than aspartic acid
APTSSSTKKTQLQLEHLLLXLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 21 - protein, 133 aa, Artificial sequence
  Synthetic polypeptide
  Misc_feature (15)..(15): any amino acid other than glutamic acid
APTSSSTKKTQLQLXHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 22 - protein, 133 aa, Artificial sequence
  Synthetic polypeptide
  Misc_feature (16)..(16): any amino acid other than histidine
APTSSSTKKTQLQLEXLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 23 - protein, 133 aa, Artificial sequence
  Synthetic polypeptide
  Misc_feature (45)..(45): any amino acid other than tyrosine
APTSSSTKKTQLQLEHLLLDLQMILNGINNYKNPKLTRMLTFKFXMPKKATELKHLQCLEEELKPLEEVLNLAQSKNFHLRPRDLISNINVIVLELKGSETTFMCEYADETATIVEFLNRWITFCQSIISTLT

SEQ ID NO: 24 - protein, 133 aa, Artificial sequence
  Synthetic polypeptide
  Misc_feature (126)..(126): any amino acid other than glutamine
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCXSIISTLT

SEQ ID NO: 25 - protein, 133 aa, Artificial sequence
  Synthetic polypeptide
  Misc_feature (16)..(16): any amino acid other than histidine
  Misc_feature (42)..(42): any amino acid other than phenylalanine
APTSSSTKKTQLQLEXLLLDLQMILNGINNYKNPKLTRMLTXKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 26 - protein, 133 aa, Artificial sequence
  Synthetic polypeptide
  Misc_feature (20)..(20): any amino acid other than aspartic acid
  Misc_feature (42)..(42): any amino acid other than phenylalanine
APTSSSTKKTQLQLEHLLLXLQMILNGINNYKNPKLTRMLTXKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 27 - protein, 133 aa, Artificial sequence
  Synthetic polypeptide
  Misc_feature (15)..(15): any amino acid other than glutamic aicd
  Misc_feature (20)..(20): any amino acid other than aspartic acid
  Misc_feature (42)..(42): any amino acid other than phenylalanine
APTSSSTKKTQLQLXHLLLXLQMILNGINNYKNPKLTRMLTXKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 28 - protein, 133 aa, Artificial sequence
  Synthetic polypeptide
  Misc_feature (16)..(16): any amino acid other than histidine
  Misc_feature (20)..(20): any amino acid other than aspartic acid
  Misc_feature (42)..(42): any amino acid other than phenylalanine
APTSSSTKKTQLQLEXLLLXLQMILNGINNYKNPKLTRMLTXKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 29 - protein, 133 aa, Artificial sequence
  Synthetic polypeptide
  Misc_feature (20)..(20): any amino acid other than aspartic acid
  Misc_feature (42)..(42): any amino acid other than phenylalanine
  Misc_feature (126)..(126): any amino acid other than glutamine
APTSSSTKKTQLQLEHLLLXLQMILNGINNYKNPKLTRMLTXKFYMPKKATELKHLQCLEEELKPLEEVLNLAQSKNFHLRPRDLISNINVIVLELKGSETTFMCEYADETATIVEFLNRWITFCXSIISTLT

SEQ ID NO: 30 - protein, 133 aa, Artificial sequence
  Synthetic polypeptide
  Misc_feature (20)..(20): any amino acid other than aspartic acid
  Misc_feature (42)..(42): any amino acid other than phenylalanine
  Misc_feature (45)..(45): any amino acid other than tyrosine
APTSSSTKKTQLQLEHLLLXLQMILNGINNYKNPKLTRMLTXKFXMPKKATELKHLQCLEEELKPLEEVLNLAQSKNFHLRPRDLISNINVIVLELKGSETTFMCEYADETATIVEFLNRWITFCQSIISTLT

SEQ ID NO: 31 - protein, 133 aa, Artificial sequence
  Synthetic polypeptide
  Misc_feature (16)..(16): any amino acid other than histidine
  Misc_feature (20)..(20): any amino acid other than aspartic acid
  Misc_feature (42)..(42): any amino acid other than phenylalanine
  Misc_feature (45)..(45): any amino acid other than tyrosine
APTSSSTKKTQLQLEXLLLXLQMILNGINNYKNPKLTRMLTXKFXMPKKATELKHLQCLEEELKPLEEVLNLAQSKNFHLRPRDLISNINVIVLELKGSETTFMCEYADETATIVEFLNRWITFCQSIISTLT

SEQ ID NO: 32 - protein, 133 aa, Artificial sequence
  Synthetic polypeptide
  Misc_feature (20)..(20): any amino acid other than aspartic acid
  Misc_feature (42)..(42): any amino acid other than phenylalanine
  Misc_feature (45)..(45): any amino acid other than tyrosine
  Misc_feature (126)..(126): any amino acid other than glutamine
APTSSSTKKTQLQLEHLLLXLQMILNGINNYKNPKLTRMLTXKFXMPKKATELKHLQCLEEELKPLEEVLNLAQSKNFHLRPRDLISNINVIVLELKGSETTFMCEYADETATIVEFLNRWITFCXSIISTLT

SEQ ID NO: 33 - protein, 133 aa, Artificial sequence
  Synthetic polypeptide
  Misc_feature (16)..(16): any amino acid other than histidine
  Misc_feature (20)..(20): any amino acid other than aspartic acid
  Misc_feature (42)..(42): any amino acid other than phenylalanine
  Misc_feature (45)..(45): any amino acid other than tyrosine
  Misc_feature (126)..(126): any amino acid other than glutamine
APTSSSTKKTQLQLEXLLLXLQMILNGINNYKNPKLTRMLTXKFXMPKKATELKHLQCLEEELKPLEEVLNLAQSKNFHLRPRDLISNINVIVLELKGSETTFMCEYADETATIVEFLNRWITFCXSIISTLT

SEQ ID NO: 34 - protein, 133 aa, Artificial sequence
  Synthetic polypeptide
  Misc_feature (16)..(16): any amino acid other than histidine
  Misc_feature (42)..(42): any amino acid other than phenylalanine
  Misc_feature (126)..(126): any amino acid other than glutamine
APTSSSTKKTQLQLEXLLLDLQMILNGINNYKNPKLTRMLTXKFYMPKKATELKHLQCLEEELKPLEEVLNLAQSKNFHLRPRDLISNINVIVLELKGSETTFMCEYADETATIVEFLNRWITFCXSIISTLT

SEQ ID NO: 35 - protein, 9 aa, Artificial sequence
  Synthetic polypeptide
YPYDVPDYA

SEQ ID NO: 36 - protein, 8 aa, Artificial sequence
  Synthetic polypeptide
DYKDDDDK

SEQ ID NO: 37 - protein, 10 aa, Artificial sequence
  Synthetic polypeptide
EQKLISEEDL

SEQ ID NO: 38 - protein, 5 aa, Artificial sequence
  Synthetic polypeptide
HHHHH

SEQ ID NO: 39 - protein, 6 aa, Artificial sequence
  Synthetic polypeptide
HHHHHH

SEQ ID NO: 40 - protein, 8 aa, Artificial sequence
  Synthetic polypeptide
WSHPQFEK

SEQ ID NO: 41 - protein, 5 aa, Artificial sequence
  Synthetic polypeptide
RYIRS

SEQ ID NO: 42 - protein, 4 aa, Artificial sequence
  Synthetic polypeptide
FHHT

SEQ ID NO: 43 - protein, 17 aa, Artificial sequence
  Synthetic polypeptide
WEAAAREACCRECCARA

SEQ ID NO: 44 - protein, 8 aa, Artificial sequence
  Synthetic polypeptide
LEVLFQGP

SEQ ID NO: 45 - protein, 7 aa, Artificial sequence
  Synthetic polypeptide
ENLYTQS

SEQ ID NO: 46 - protein, 5 aa, Artificial sequence
  Synthetic polypeptide
DDDDK

SEQ ID NO: 47 - protein, 4 aa, Artificial sequence
  Synthetic polypeptide
LVPR

SEQ ID NO: 48 - protein, 22 aa, Artificial sequence
  Synthetic polypeptide
GSGATNFSLLKQAGDVEENPGP

SEQ ID NO: 49 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 50 - protein, 119 aa, Macaca mulatta
MSRSVALAVLALLSLSGLEAIQRTPKIQVYSRHPPENGKPNFLNCYVSGFHPSDIEVDLLKNGEKMGKVEHSDLSFSKDWSFYLLYYTEFTPNEKDEYACRVNHVTLSGPRTVKWDRDM

SEQ ID NO: 51 - protein, 118 aa, Bos taurus
MARFVALVLLGLLSLSGLDAIQRPPKIQVYSRHPPEDGKPNYLNCYVYGFHPPQIEIDLLKNGEKIKSEQSDLSFSKDWSFYLLSHAEFTPNSKDQYSCRVKHVTLEQPRIVKWDRDL

SEQ ID NO: 52 - protein, 119 aa, Mus musculus
MARSVTLVFLVLVSLTGLYAIQKTPQIQVYSRHPPENGKPNILNCYVTQFHPPHIEIQMLKNGKKIPKVEMSDMSFSKDWSFYILAHTEFTPTETDTYACRVKHASMAEPKTVYWDRDM

SEQ ID NO: 53 - protein, 276 aa, Homo sapiens [sequence omitted]

SEQ ID NO: 54 - protein, 274 aa, Mus musculus
GPHSLRYFVTAVSRPGLGEPRFIAVGYVDDTQFVRFDSDADNPRFEPRAPWMEQEGPEYWEEQTQRAKSDEQWFRVSLRTAQRYYNQSKGGSHTFQRMFGCDVGSDWRLLRGYQQFAYDGRDYIALNEDLKTWTAADTAALITRRKWEQAGDAEYYRAYLEGECVEWLRRYLELGNETLLRTDSPKAHVTYHPRSQVDVTLRCWALGFYPADITLTWQLNGEDLTQDMELVETRPAGDGTFQKWAAVVVPLGKEQNYTCHVHHKGLPEPLTLRW

SEQ ID NO: 55 - protein, 99 aa, Homo sapiens [sequence omitted]

SEQ ID NO: 56 - protein, 99 aa, Homo sapiens
IQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 57 - protein, 276 aa, Homo sapiens
GSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEP

SEQ ID NO: 58 - protein, 275 aa, Homo sapiens
GSHSMRYFFTSVSRPGRGEPRFIAVGYVDDTQFVRFDSDAASQRMEPRAPWIEQEGPEYWDGETRKVKAHSQTHRVDLGTLRGAYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWE

SEQ ID NO: 59 - protein, 5 aa, Artificial sequence
  Synthetic polypeptide
  Misc_feature (4)..(4): any amino acid other than proline
VPGXG

SEQ ID NO: 60 - protein, 5 aa, Artificial sequence
  Synthetic polypeptide
GSGGS

SEQ ID NO: 61 - protein, 4 aa, Artificial sequence
  Synthetic polypeptide
GGGS

SEQ ID NO: 62 - protein, 4 aa, Artificial sequence
  Synthetic polypeptide
GGSG

SEQ ID NO: 63 - protein, 5 aa, Artificial sequence
  Synthetic polypeptide
GGSGG

SEQ ID NO: 64 - protein, 5 aa, Artificial sequence
  Synthetic polypeptide
GSGSG

SEQ ID NO: 65 - protein, 5 aa, Artificial sequence
  Synthetic polypeptide
GSGGG

SEQ ID NO: 66 - protein, 5 aa, Artificial sequence
  Synthetic polypeptide
GGGSG

SEQ ID NO: 67 - protein, 5 aa, Artificial sequence
  Synthetic polypeptide
GSSSG

SEQ ID NO: 68 - protein, 5 aa, Artificial sequence
  Synthetic polypeptide
GSSSS

SEQ ID NO: 69 - protein, 5 aa, Artificial sequence
  Synthetic polypeptide
GGGGS

SEQ ID NO: 70 - protein, 5 aa, Artificial sequence
  Synthetic polypeptide
AAAGG

SEQ ID NO: 71 - protein, 15 aa, Artificial sequence
  Synthetic polypeptide
GCGASGGGGSGGGGS

SEQ ID NO: 72 - protein, 9 aa, Artificial sequence
  Synthetic polypeptide
LLMGTLGIV

SEQ ID NO: 73 - protein, 8 aa, Artificial sequence
  Synthetic polypeptide
TLGIVCPI

SEQ ID NO: 74 - protein, 10 aa, Artificial sequence
  Synthetic polypeptide
YMLDLQPETT

SEQ ID NO: 75 - protein, 9 aa, Artificial sequence
  Synthetic polypeptide
YMLDLQPET

SEQ ID NO: 76 - protein, 219 aa, Artificial sequence
  Synthetic polypeptide
  Misc_feature (8)..(8): any amino acid other than aspartic acid
FTVTVPKXLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKI

SEQ ID NO: 77 - protein, 219 aa, Artificial sequence
  Synthetic polypeptide
  Misc_feature (36)..(36): any amino acid other than isoleucine
FTVTVPKDLYVVEYGSNMTIECKFPVEKQLDLAALXVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKI

SEQ ID NO: 78 - protein, 219 aa, Artificial sequence
  Synthetic polypeptide
  Misc_feature (54)..(54): any amino acid other than glutamine
FTVTVPKDLYVVEYGSNMTIECKFPVEKQLDLAALIVYWEMEDKNIIQFVHGEXDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKI

SEQ ID NO: 79 - protein, 208 aa, Artificial sequence
  Synthetic polypeptide
  Misc_feature (19)..(19): any amino acid other than asparagine
VIHVTKEVKEVATLSCGHXVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 80 - protein, 208 aa, Artificial sequence
  Synthetic polypeptide
  Misc_feature (63)..(63): any amino acid other than asparagine
VIHVTKEVKEVATLSCGHNVSVEELAQTRIYWQKEKKMVLTMMSGDMNIWPEYKNRTIFDITXNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 81 - protein, 208 aa, Artificial sequence
  Synthetic polypeptide
  Misc_feature (67)..(67): any amino acid other than isoleucine
VIHVTKEVKEVATLSCGHNVSVEELAQTRIYWQKEKKMVLTMMSGDMNIWPEYKNRTIFDITNNLSXVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 82 - protein, 208 aa, Artificial sequence
  Synthetic polypeptide
  Misc_feature (86)..(86): any amino acid other than lysine
VIHVTKEVKEVATLSCGHNVSVEELAQTRIYWQKEKKMVLTMMSGDMNIWPEYKNRTIFDITNNLSIVILALRPSDEGTYECVVLXYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 83 - protein, 208 aa, Artificial sequence
  Synthetic polypeptide
  Misc_feature (157)..(157): any amino acid other than glutamine
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSXDPETELYAVSSKLDFNMTTNHSFMCLIKYGHLRVNQTFNWNTTKQEHFPDN

SEQ ID NO: 84 - protein, 208 aa, Artificial sequence
  Synthetic polypeptide
  Misc_feature (158)..(158): any amino acid other than aspartic acid
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQXPETELYAVSSKLDFNMTTNHSFMCLIKYGHLRVNQTFNWNTTKQEHFPDN

SEQ ID NO: 85 - protein, 208 aa, Artificial sequence
  Synthetic polypeptide
  Misc_feature (25)..(25): any amino acid other than leucine
VIHVTKEVKEVATLSCGHNVSVEEXAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 86 - protein, 208 aa, Artificial sequence
  Synthetic polypeptide
  Misc_feature (31)..(31): any amino acid other than tyrosine
VIHVTKEVKEVATLSCGHNVSVEELAQTRIXWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 87 - protein, 208 aa, Artificial sequence
  Synthetic polypeptide
  Misc_feature (33)..(33): any amino acid other than glutamine
VIHVTKEVKEVATLSCGHNVSVEELAQTRIYWXKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 88 - protein, 208 aa, Artificial sequence
  Synthetic polypeptide
  Misc_feautre (38)..(38): any amino acid other than methionine
VIHVTKEVKEVATLSCGHNVSVEELAQTRIYWQKEKKXVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 89 - protein, 208 aa, Artificial sequence
  Synthetic polypeptide
  Misc_feature (39)..(39): any amino acid other than valine
VIHVTKEVKEVATLSCGHNVSVEELAQTRIYWQKEKKMXLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 90 - protein, 208 aa, Artificial sequence
  Synthetic polypeptide
  Misc_feature (49)..(49): any amino acid other than isoleucine
VIHVTKEVKEVATLSCGHNVSVEELAQTRIYWQKEKKMVLTMMSGDMNXWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 91 - protein, 208 aa, Artificial sequence
  Synthetic polypeptide
  Misc_feature (53)..(53): any amino acid other than tyrosine
VIHVTKEVKEVATLSCGHNVSVEELAQTRIYWQKEKKMVLTMMSGDMNIWPEXKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 92 - protein, 208 aa, Artificial sequence
  Synthetic polypeptide
  Misc_feature (60)..(60): any amino acid other than aspartic acid
VIHVTKEVKEVATLSCGHNVSVEELAQTRIYWQKEKKMVLTMMSGDMNIWPEYKNRTIFXITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 93 - protein, 208 aa, Artificial sequence
  Synthetic polypeptide
  Misc_feature (108)..(108): any amino acid other than phenylalanine
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADXPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 94 - protein, 208 aa, Artificial sequence
  Synthetic polypeptide
  Misc_feature (156)..(156): any amino acid other than serine
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVXQDPETELYAVSSKLDFNMTTNHSFMCLIKYGHLRVNQTFNWNTTKQEHFPDN

SEQ ID NO: 95 - protein, 208 aa, Artificial sequence
  Synthetic polypeptide
  Misc_feature (111)..(111): any amino acid other than proline
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTXSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 96 - protein, 224 aa, Artificial sequence
  Synthetic polypeptide
  Misc_feature (61)..(61): any amino acid other than asparagine
APLKIQAYFNETADLPCQFANSQNQSLSELVVFWQDQENLVLNEVYLGKEKFDSVHSKYMXRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 97 - protein, 224 aa, Artificial sequence
  Synthetic polypeptide
  Misc_feature (66)..(66): any amino acid other than aspartic acid
APLKIQAYFNETADLPCQFANSQNQSLSELVVFWQDQENLVLNEVYLGKEKFDSVHSKYMNRTSFXSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 98 - protein, 224 aa, Artificial sequence
  Synthetic polypeptide
  Misc_feature (70)..(70): any amino acid other than tryptophan
APLKIQAYFNETADLPCQFANSQNQSLSELVVFWQDQENLVLNEVYLGKEKFDSVHSKYMNRTSFDSDSXTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 99 - protein, 224 aa, Artificial sequence
  Synthetic polypeptide
  Misc_feature (91)..(91): any amino acid other than histidine
APLKIQAYFNETADLPCQFANSQNQSLSELVVFWQDQENLVLNEVYLGKEKFDSVHSKYMNRTSFDSDSWTLRLHNLQIKDKGLYQCIIHXKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 100 - protein, 110 aa, Artificial sequence
  Synthetic polypeptide
  Misc_feature (61)..(61): any amino acid other than asparagine
APLKIQAYFNETADLPCQFANSQNQSLSELVVFWQDQENLVLNEVYLGKEKFDSVHSKYMXRTSFDSDSWTLRLHNLQIKDKGLYQCIIHHKKPTGMIRIHQMNSELSVL

SEQ ID NO: 101 - protein, 110 aa, Artificial sequence
  Synthetic polypeptide
  Misc_feature (66)..(66): any amino acid other than aspartic acid
APLKIQAYFNETADLPCQFANSQNQSLSELVVFWQDQENLVLNEVYLGKEKFDSVHSKYMNRTSFXSDSWTLRLHNLQIKDKGLYQCIIHHKKPTGMIRIHQMNSELSVL

SEQ ID NO: 102 - protein, 110 aa, Artificial sequence
  Synthetic polypeptide
  Misc_feature (70)..(70): any amino acid other than tryptophan
APLKIQAYFNETADLPCQFANSQNQSLSELVVFWQDQENLVLNEVYLGKEKFDSVHSKYMNRTSFDSDSXTLRLHNLQIKDKGLYQCIIHHKKPTGMIRIHQMNSELSVL

SEQ ID NO: 103 - protein, 110 aa, Artificial sequence
  Synthetic polypeptide
  Misc_feature (91)..(91): any amino acid other than histidine
APLKIQAYFNETADLPCQFANSQNQSLSELVVFWQDQENLVLNEVYLGKEKFDSVHSKYMNRTSFDSDSWTLRLHNLQIKDKGLYQCIIHXKKPTGMIRIHQMNSELSVL

SEQ ID NO: 104 - protein, 224 aa, Artificial sequence
  Synthetic polypeptide
  Misc_feature (41)..(41): any amino acid other than valine
APLKIQAYFNETADLPCQFANSQNQSLSELVVFWQDQENLXLNEVYLGKEKFDSVHSKYMNRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 105 - protein, 110 aa, Artificial sequence
  Synthetic polypeptide
  Misc_feature (41)..(41): any amino acid other than valine
APLKIQAYFNETADLPCQFANSQNQSLSELVVFWQDQENLXLNEVYLGKEKFDSVHSKYMNRTSFDSDSWTLRLHNLQIKDKGLYQCIIHHKKPTGMIRIHQMNSELSVL

SEQ ID NO: 106 - protein, 224 aa, Artificial sequence
  Synthetic polypeptide
  Misc_feature (35)..(35): any amino acid other than glutamine
APLKIQAYFNETADLPCQFANSQNQSLSELVVFWXDQENLVLNEVYLGKEKFDSVHSKYMNRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 107 - protein, 110 aa, Artificial sequence
  Synthetic polypeptide
  Misc_feature (35)..(35): any amino acid other than glutamine
APLKIQAYFNETADLPCQFANSQNQSLSELVVFWXDQENLVLNEVYLGKEKFDSVHSKYMNRTSFDSDSWTLRLHNLQIKDKGLYQCIIHHKKPTGMIRIHQMNSELSVL

SEQ ID NO: 108 - protein, 224 aa, Artificial sequence
  Synthetic polypeptide
  Misc_feature (33)..(33): any amino acid other than phenylalanine
APLKIQAYFNETADLPCQFANSQNQSLSELVVXWQDQENLVLNEVYLGKEKFDSVHSKYMNRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 109 - protein, 110 aa, Artificial sequence
  Synthetic polypeptide
  Misc_feature (33)..(33): any amino acid other than phenylalanine
APLKIQAYFNETADLPCQFANSQNQSLSELVVXWQDQENLVLNEVYLGKEKFDSVHSKYMNRTSFDSDSWTLRLHNLQIKDKGLYQCIIHHKKPTGMIRIHQMNSELSVL

SEQ ID NO: 110 - protein, 224 aa, Artificial sequence
  Synthetic polypeptide
  Misc_feature (72)..(72): any amino acid other than leucine
APLKIQAYFNETADLPCQFANSQNQSLSELVVFWQDQENLVLNEVYLGKEKFDSVHSKYMNRTSFDSDSWTXRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 111 - protein, 110 aa, Artificial sequence
  Synthetic polypeptide
  Misc_feature (72)..(72): any amino acid other than leucine
APLKIQAYFNETADLPCQFANSQNQSLSELVVFWQDQENLVLNEVYLGKEKFDSVHSKYMNRTSFDSDSWTXRLHNLQIKDKGLYQCIIHHKKPTGMIRIHQMNSELSVL

SEQ ID NO: 112 - protein, 224 aa, Artificial sequence
  Synthetic polypeptide
  Misc_feature (59)..(59): any amino acid other than tyrosine
APLKIQAYFNETADLPCQFANSQNQSLSELVVFWQDQENLVLNEVYLGKEKFDSVHSKXMNRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 113 - protein, 110 aa, Artificial sequence
  Synthetic polypeptide
  Misc_feature (59)..(59): any amino acid other than tyrosine
APLKIQAYFNETADLPCQFANSQNQSLSELVVFWQDQENLVLNEVYLGKEKFDSVHSKXMNRTSFDSDSWTLRLHNLQIKDKGLYQCIIHHKKPTGMIRIHQMNSELSVL

SEQ ID NO: 114 - protein, 224 aa, Artificial sequence
  Synthetic polypeptide
  Misc_feature (61)..(61): any amino acid other than asparagine
  Misc_feature (91)..(91): any amino acid other than histidine
APLKIQAYFNETADLPCQFANSQNQSLSELVVFWQDQENLVLNEVYLGKEKFDSVHSKYMXRTSFDSDSWTLRLHNLQIKDKGLYQCIIHXKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 115 - protein, 110 aa, Artificial sequence
  Synthetic polypeptide
  Misc_feature (61)..(61): any amino acid other than asparagine
  Misc_feature (91)..(91): any amino acid other than histidine
APLKIQAYFNETADLPCQFANSQNQSLSELVVFWQDQENLVLNEVYLGKEKFDSVHSKYMXRTSFDSDSWTLRLHNLQIKDKGLYQCIIHXKKPTGMIRIHQMNSELSVL

SEQ ID NO: 116 - protein, 224 aa, Artificial sequence
  Synthetic polypeptide
  Misc_feature (66)..(66): any amino acid other than aspartic acid
  Misc_feature (91)..(91): any amino acid other than histidine
APLKIQAYFNETADLPCQFANSQNQSLSELVVFWQDQENLVLNEVYLGKEKFDSVHSKYMNRTSFXSDSWTLRLHNLQIKDKGLYQCIIHXKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 117 - protein, 110 aa, Artificial sequence
  Synthetic polypeptide
  Misc_feature (17)..(17): any amino acid other than asparagine
  misc_feature (66)..(66): Xaa can be any amino acid other than His
  Misc_feature (91)..(91): any amino acid other than histidine
APLKIQAYFNETADLPCQFANSQNQSLSELVVFWQDQENLVLNEVYLGKEKFDSVHSKYMNRTSFXSDSWTLRLHNLQIKDKGLYQCIIHXKKPTGMIRIHQMNSELSVL

SEQ ID NO: 118 - protein, 224 aa, Artificial sequence
  Synthetic polypeptide
  Misc_feature (61)..(61): any amino acid other than asparagine
  Misc_feature (66)..(66): any amino acid other than aspartic acid
  Misc_feature (91)..(91): any amino acid other than histidine
APLKIQAYFNETADLPCQFANSQNQSLSELVVFWQDQENLVLNEVYLGKEKFDSVHSKYMXRTSFXSDSWTLRLHNLQIKDKGLYQCIIHXKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIP

SEQ ID NO: 119 - protein, 110 aa, Artificial sequence
  Synthetic polypeptide
  Misc_feature (61)..(61): any amino acid other than asparagine
  Misc_feature (66)..(66): any amino acid other than aspartic acid
  Misc_feature (91)..(91): any amino acid other than histidine
APLKIQAYFNETADLPCQFANSQNQSLSELVVFWQDQENLVLNEVYLGKEKFDSVHSKYMXRTSFXSDSWTLRLHNLQIKDKGLYQCIIHXKKPTGMIRIHQMNSELSVL

SEQ ID NO: 120 - protein, 174 aa, Artificial sequence
  Synthetic polypeptide
  Misc_feature (47)..(47): any amino acid other than lysine
PAGLLDLRQGMFAQLVAQNVLLIDGPLSWYSDPGLAGVSLTGGLSYXEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 121 - protein, 174 aa, Artificial sequence
  Synthetic polypeptide
  Misc_feature (147)..(147): any amino acid other than glutamine
PAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWXLTQGATVLGLFRVTPEIPAGLPSPRSE

SEQ ID NO: 122 - protein, 174 aa, Artificial sequence
  Synthetic polypeptide
  Misc_feature (11)..(11): any amino acid other than methionine
PAGLLDLRQGXFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 123 - protein, 174 aa, Artificial sequence
  Synthetic polypeptide
  Misc_feature (12)..(12): any amino acid other than phenylalanine
PAGLLDLRQGMXAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 124 - protein, 174 aa, Artificial sequence
  Synthetic polypeptide
  Misc_feature (14)..(14): any amino acid other than glutamine
PAGLLDLRQGMFAXLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 125 - protein, 174 aa, Artificial sequence
  Synthetic polypeptide
  Misc_feature (15)..(15): any amino acid other than leucine
PAGLLDLRQGMFAQXVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 126 - protein, 174 aa, Artificial sequence
  Synthetic polypeptide
  Misc_feature (16)..(16): any amino acid other than valine
PAGLLDLRQGMFAQLXAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 127 - protein, 174 aa, Artificial sequence
  Synthetic polypeptide
  Misc_feature (18)..(18): any amino acid other than glutamine
PAGLLDLRQGMFAQLVAXNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 128 - protein, 174 aa, Artificial sequence
  Synthetic polypeptide
  Misc_feature (19)..(19): any amino acid other than asparagine
PAGLLDLRQGMFAQLVAQXVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 129 - protein, 174 aa, Artificial sequence
  Synthetic polypeptide
  Misc_feature (20)..(20): any amino acid other than valine
PAGLLDLRQGMFAQLVAQNXLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 130 - protein, 174 aa, Artificial sequence
  Synthetic polypeptide
  Misc_feature (21)..(21): any amino acid other than leucine
PAGLLDLRQGMFAQLVAQNVXLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 131 - protein, 174 aa, Artificial sequence
  Synthetic polypeptide
  Misc_feature (22)..(22): any amino acid other than leucine
PAGLLDLRQGMFAQLVAQNVLXIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 132 - protein, 174 aa, Artificial sequence
  Synthetic polypeptide
  Misc_feature (23)..(23): any amino acid other than isoleucine
PAGLLDLRQGMFAQLVAQNVLLXDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 133 - protein, 174 aa, Artificial sequence
  Synthetic polypeptide
  Misc_feature (24)..(24): any amino acid other than aspartic acid
PAGLLDLRQGMFAQLVAQNVLLIXGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 134 - protein, 174 aa, Artificial sequence
  Synthetic polypeptide
  Misc_feature (25)..(25): any amino acid other than glycine
PAGLLDLRQGMFAQLVAQNVLLIDXPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 135 - protein, 174 aa, Artificial sequence
  Synthetic polypeptide
  Misc_feature (26)..(26): any amino acid other than proline
PAGLLDLRQGMFAQLVAQNVLLIGGXLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 136 - protein, 174 aa, Artificial sequence
  Synthetic polypeptide
  Misc_feature (27)..(27): any amino acid other than leucine
PAGLLDLRQGMFAQLVAQNVLLIGGPXSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 137 - protein, 174 aa, Artificial sequence
  Synthetic polypeptide
  Misc_feature (28)..(28): any amino acid other than serine
PAGLLDLRQGMFAQLVAQNVLLIGGPLXWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 138 - protein, 174 aa, Artificial sequence
  Synthetic polypeptide
  Misc_feature (29)..(29): any amino acid other than tryptophan
PAGLLDLRQGMFAQLVAQNVLLIGGPLSXYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 139 - protein, 174 aa, Artificial sequence
  Synthetic polypeptide
  Misc_feature (30)..(30): any amino acid other than tyrosine
PAGLLDLRQGMFAQLVAQNVLLIGGPLSWXSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 140 - protein, 174 aa, Artificial sequence
  Synthetic polypeptide
  Misc_feature (31)..(31): any amino acid other than serine
PAGLLDLRQGMFAQLVAQNVLLIGGPLSWYXDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 141 - protein, 174 aa, Artificial sequence
  Synthetic polypeptide
  Misc_feature (32)..(32): any amino acid other than aspartic acid
PAGLLDLRQGMFAQLVAQNVLLIGGPLSWYSXPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 142 - protein, 174 aa, Artificial sequence
  Synthetic polypeptide
  Misc_feature (33)..(33): any amino acid other than proline
PAGLLDLRQGMFAQLVAQNVLLIGGPLSWYSDXGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 143 - protein, 174 aa, Artificial sequence
  Synthetic polypeptide
  Misc_feature (34)..(34): any amino acid other than glycine
PAGLLDLRQGMFAQLVAQNVLLIGGPLSWYSDPXLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 144 - protein, 174 aa, Artificial sequence
  Synthetic polypeptide
  Misc_feature (35)..(35): any amino acid other than leucine
PAGLLDLRQGMFAQLVAQNVLLIGGPLSWYSDPGXAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 145 - protein, 174 aa, Artificial sequence
  Synthetic polypeptide
  Misc_feature (37)..(37): any amino acid other than glycine
PAGLLDLRQGMFAQLVAQNVLLIGGPLSWYSDPGLAXVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 146 - protein, 174 aa, Artificial sequence
  Synthetic polypeptide
  Misc_feature (38)..(38): any amino acid other than valine
PAGLLDLRQGMFAQLVAQNVLLIGGPLSWYSDPGLAGXSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 147 - protein, 174 aa, Artificial sequence
  Synthetic polypeptide
  Misc_feature (39)..(39): any amino acid other than serine
PAGLLDLRQGMFAQLVAQNVLLIGGPLSWYSDPGLAGVXLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 148 - protein, 174 aa, Artificial sequence
  Synthetic polypeptide
  Misc_feature (40)..(40): any amino acid other than leucine
PAGLLDLRQGMFAQLVAQNVLLIGGPLSWYSDPGLAGVSXTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 149 - protein, 174 aa, Artificial sequence
  Synthetic polypeptide
  Misc_feature (41)..(41): any amino acid other than threonine
PAGLLDLRQGMFAQLVAQNVLLIGGPLSWYSDPGLAGVSLXGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 150 - protein, 174 aa, Artificial sequence
  Synthetic polypeptide
  Misc_feature (42)..(42): any amino acid other than glycine
PAGLLDLRQGMFAQLVAQNVLLIGGPLSWYSDPGLAGVSLTXGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 151 - protein, 174 aa, Artificial sequence
  Synthetic polypeptide
  Misc_feature (43)..(43): any amino acid other than glycine
PAGLLDLRQGMFAQLVAQNVLLIGGPLSWYSDPGLAGVSLTGXLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 152 - protein, 174 aa, Artificial sequence
  Synthetic polypeptide
  Misc_feature (44)..(44): any amino acid other than leucine
PAGLLDLRQGMFAQLVAQNVLLIGGPLSWYSDPGLAGVSLTGGXSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 153 - protein, 174 aa, Artificial sequence
  Synthetic polypeptide
  Misc_feature (45)..(45): any amino acid other than serine
PAGLLDLRQGMFAQLVAQNVLLIGGPLSWYSDPGLAGVSLTGGLXYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 154 - protein, 174 aa, Artificial sequence
  Synthetic polypeptide
  Misc_feature (46)..(46): any amino acid other than tyrosine
PAGLLDLRQGMFAQLVAQNVLLIGGPLSWYSDPGLAGVSLTGGLSXKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 155 - protein, 174 aa, Artificial sequence
  Synthetic polypeptide
  Misc_feature (48)..(48): any amino acid other than glutamic acid
PAGLLDLRQGMFAQLVAQNVLLIGGPLSWYSDPGLAGVSLTGGLSYKXDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 156 - protein, 174 aa, Artificial sequence
  Synthetic polypeptide
  Misc_feature (49)..(49): any amino acid other than aspartic acid
PAGLLDLRQGMFAQLVAQNVLLIGGPLSWYSDPGLAGVSLTGGLSYKEXTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 157 - protein, 174 aa, Artificial sequence
  Synthetic polypeptide
  Misc_feature (50)..(50): any amino acid other than threonine
PAGLLDLRQGMFAQLVAQNVLLIGGPLSWYSDPGLAGVSLTGGLSYKEDXKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 158 - protein, 174 aa, Artificial sequence
  Synthetic polypeptide
  Misc_feature (51)..(51): any amino acid other than lysine
PAGLLDLRQGMFAQLVAQNVLLIGGPLSWYSDPGLAGVSLTGGLSYKEDTXELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 159 - protein, 174 aa, Artificial sequence
  Synthetic polypeptide
  Misc_feature (52)..(52): any amino acid other than glutamic acid
PAGLLDLRQGMFAQLVAQNVLLIGGPLSWYSDPGLAGVSLTGGLSYKEDTKXLVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 160 - protein, 174 aa, Artificial sequence
  Synthetic polypeptide
  Misc_feature (64)..(64): any amino acid other than phenylalanine
PAGLLDLRQGMFAQLVAQNVLLIGGPLSWYSDPGLAGVSLTGGLSYKEDTKELVVAKAGVYYVXFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 161 - protein, 174 aa, Artificial sequence
  Synthetic polypeptide
  Misc_feature (65)..(65): any amino acid other than phenylalanine
PAGLLDLRQGMFAQLVAQNVLLIGGPLSWYSDPGLAGVSLTGGLSYKEDTKELVVAKAGVYYVFXQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 162 - protein, 174 aa, Artificial sequence
  Synthetic polypeptide
  Misc_feature (66)..(66): any amino acid other than glutamine
PAGLLDLRQGMFAQLVAQNVLLIGGPLSWYSDPGLAGVSLTGGLSYKEDTKELVVAKAGVYYVFFXLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 163 - protein, 174 aa, Artificial sequence
  Synthetic polypeptide
  Misc_feature (67)..(67): any amino acid other than leucine
PAGLLDLRQGMFAQLVAQNVLLIGGPLSWYSDPGLAGVSLTGGLSYKEDTKELVVAKAGVYYVFFQXELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 164 - protein, 174 aa, Artificial sequence
  Synthetic polypeptide
  Misc_feature (68)..(68): any amino acid other than glutamic acid
PAGLLDLRQGMFAQLVAQNVLLIGGPLSWYSDPGLAGVSLTGGLSYKEDTKELVVAKAGVYYVFFQLXLRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 165 - protein, 174 aa, Artificial sequence
  Synthetic polypeptide
  Misc_feature (69)..(69): any amino acid other than leucine
PAGLLDLRQGMFAQLVAQNVLLIGGPLSWYSDPGLAGVSLTGGLSYKEDTKELVVAKAGVYYVFFQLEXRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 166 - protein, 174 aa, Artificial sequence
  Synthetic polypeptide
  Misc_feature (70)..(70): any amino acid other than arginine
PAGLLDLRQGMFAQLVAQNVLLIGGPLSWYSDPGLAGVSLTGGLSYKEDTKELVVAKAGVYYVFFQLELXRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 167 - protein, 174 aa, Artificial sequence
  Synthetic polypeptide
  Misc_feature (71)..(71): any amino acid other than arginine
PAGLLDLRQGMFAQLVAQNVLLIGGPLSWYSDPGLAGVSLTGGLSYKEDTKELVVAKAGVYYVFFQLELRXVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 168 - protein, 174 aa, Artificial sequence
  Synthetic polypeptide
  Misc_feature (72)..(72): any amino acid other than valine
PAGLLDLRQGMFAQLVAQNVLLIGGPLSWYSDPGLAGVSLTGGLSYKEDTKELVVAKAGVYYVFFQLELRRXVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 169 - protein, 174 aa, Artificial sequence
  Synthetic polypeptide
  Misc_feature (73)..(73): any amino acid other than valine
PAGLLDLRQGMFAQLVAQNVLLIGGPLSWYSDPGLAGVSLTGGLSYKEDTKELVVAKAGVYYVFFQLELRRVXAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 170 - protein, 174 aa, Artificial sequence
  Synthetic polypeptide
  Misc_feature (75)..(75): any amino acid other than glycine
PAGLLDLRQGMFAQLVAQNVLLIGGPLSWYSDPGLAGVSLTGGLSYKEDTKELVVAKAGVYYVFFQLELRRVVAXEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 171 - protein, 174 aa, Artificial sequence
  Synthetic polypeptide
  Misc_feature (76)..(76): any amino acid other than glutamic acid
PAGLLDLRQGMFAQLVAQNVLLIGGPLSWYSDPGLAGVSLTGGLSYKEDTKELVVAKAGVYYVFFQLELRRVVAGXGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 172 - protein, 174 aa, Artificial sequence
  Synthetic polypeptide
  Misc_feature (77)..(77): any amino acid other than glycine
PAGLLDLRQGMFAQLVAQNVLLIGGPLSWYSDPGLAGVSLTGGLSYKEDTKELVVAKAGVYYVFFQLELRRVVAGEXSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 173 - protein, 174 aa, Artificial sequence
  Synthetic polypeptide
  Misc_feature (78)..(78): any amino acid other than serine
PAGLLDLRQGMFAQLVAQNVLLIGGPLSWYSDPGLAGVSLTGGLSYKEDTKELVVAKAGVYYVFFQLELRRVVAGEGXGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 174 - protein, 174 aa, Artificial sequence
  Synthetic polypeptide
  Misc_feature (104)..(104): any amino acid other than aspartic acid
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVXLPPASSEARNSAFGFQGRLLHLSAGQRLGVHLHTEARARHAWQLTQGATVLGLFRVTPEIPAGLPSPRSE

SEQ ID NO: 175 - protein, 174 aa, Artificial sequence
  Synthetic polypeptide
  Misc_feature (105)..(105): any amino acid other than leucine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDXPPASSEARNSAFGFQGRLLHLSAGQRLGVHLHTEARARHAWQLTQGATVLGLFRVTPEIPAGLPSPRSE

SEQ ID NO: 176 - protein, 174 aa, Artificial sequence
  Synthetic polypeptide
  Misc_feature (106)..(106): any amino acid other than proline
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLXPASSEARNSAFGFQGRLLHLSAGQRLGVHLHTEARARHAWQLTQGATVLGLFRVTPEIPAGLPSPRSE

SEQ ID NO: 177 - protein, 174 aa, Artificial sequence
  Synthetic polypeptide
  Misc_feature (109)..(109): any amino acid other than serine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPAXSEARNSAFGFQGRLLHLSAGQRLGVHLHTEARARHAWQLTQGATVLGLFRVTPEIPAGLPSPRSE

SEQ ID NO: 178 - protein, 174 aa, Artificial sequence
  Synthetic polypeptide
  Misc_feature (110)..(110): any amino acid other than serine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASXEARNSAFGFQGRLLHLSAGQRLGVHLHTEARARHAWQLTQGATVLGLFRVTPEIPAGLPSPRSE

SEQ ID NO: 179 - protein, 174 aa, Artificial sequence
  Synthetic polypeptide
  Misc_feature (111)..(111): any amino acid other than glutamic acid
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSXARNSAFGFQGRLLHLSAGQRLGVHLHTEARARHAWQLTQGATVLGLFRVTPEIPAGLPSPRSE

SEQ ID NO: 180 - protein, 174 aa, Artificial sequence
  Synthetic polypeptide
  Misc_feature (113)..(113): any amino acid other than arginine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEAXNSAFGFQGRLLHLSAGQRLGVHLHTEARARHAWQLTQGATVLGLFRVTPEIPAGLPSPRSE

SEQ ID NO: 181 - protein, 174 aa, Artificial sequence
  Synthetic polypeptide
  Misc_feature (114)..(114): any amino acid other than asparagine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARXSAFGFQGRLLHLSAGQRLGVHLHTEARARHAWQLTQGATVLGLFRVTPEIPAGLPSPRSE

SEQ ID NO: 182 - protein, 174 aa, Artificial sequence
  Synthetic polypeptide
  Misc_feature (115)..(115): any amino acid other than serine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNXAFGFQGRLLHLSAGQRLGVHLHTEARARHAWQLTQGATVLGLFRVTPEIPAGLPSPRSE

SEQ ID NO: 183 - protein, 174 aa, Artificial sequence
  Synthetic polypeptide
  Misc_feature (117)..(117): any amino acid other than phenylalanine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAXGFQGRLLHLSAGQRLGVHLHTEARARHAWQLTQGATVLGLFRVTPEIPAGLPSPRSE

SEQ ID NO: 184 - protein, 174 aa, Artificial sequence
  Synthetic polypeptide
  Misc_feature (130)..(130): any amino acid other than glutamine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGXRLGVHLHTEARARHAWQLTQGATVLGLFRVTPEIPAGLPSPRSE

SEQ ID NO: 185 - protein, 174 aa, Artificial sequence
  Synthetic polypeptide
  Misc_feature (131)..(131): any amino acid other than arginine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQXLGVHLHTEARARHAWQLTQGATVLGLFRVTPEIPAGLPSPRSE

SEQ ID NO: 186 - protein, 174 aa, Artificial sequence
  Synthetic polypeptide
  Misc_feature (132)..(132): any amino acid other than leucine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRXGVHLHTEARARHAWQLTQGATVLGLFRVTPEIPAGLPSPRSE

SEQ ID NO: 187 - protein, 174 aa, Artificial sequence
  Synthetic polypeptide
  Misc_feature (133)..(133): any amino acid other than glycine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLXVHLHTEARARHAWQLTQGATVLGLFRVTPEIPAGLPSPRSE

SEQ ID NO: 188 - protein, 174 aa, Artificial sequence
  Synthetic polypeptide
  Misc_feature (134)..(134): any amino acid other than valine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGXHLHTEARARHAWQLTQGATVLGLFRVTPEIPAGLPSPRSE

SEQ ID NO: 189 - protein, 174 aa, Artificial sequence
  Synthetic polypeptide
  Misc_feature (135)..(135): any amino acid other than histidine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVXLHTEARARHAWQLTQGATVLGLFRVTPEIPAGLPSPRSE

SEQ ID NO: 190 - protein, 174 aa, Artificial sequence
  Synthetic polypeptide
  Misc_feature (136)..(136): any amino acid other than leucine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHXHTEARARHAWQLTQGATVLGLFRVTPEIPAGLPSPRSE

SEQ ID NO: 191 - protein, 174 aa, Artificial sequence
  Synthetic polypeptide
  Misc_feature (137)..(137): any amino acid other than histidine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLXTEARARHAWQLTQGATVLGLFRVTPEIPAGLPSPRSE

SEQ ID NO: 192 - protein, 174 aa, Artificial sequence
  Synthetic polypeptide
  Misc_feature (138)..(138): any amino acid other than threonine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHXEARARHAWQLTQGATVLGLFRVTPEIPAGLPSPRSE

SEQ ID NO: 193 - protein, 174 aa, Artificial sequence
  Synthetic polypeptide
  Misc_feature (139)..(139): any amino acid other than glutamic acid
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTXARARHAWQLTQGATVLGLFRVTPEIPAGLPSPRSE

SEQ ID NO: 194 - protein, 174 aa, Artificial sequence
  Synthetic polypeptide
  Misc_feature (141)..(141): any amino acid other than arginine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEAXARHAWQLTQGATVLGLFRVTPEIPAGLPSPRSE

SEQ ID NO: 195 - protein, 174 aa, Artificial sequence
  Synthetic polypeptide
  Misc_feature (143)..(143): any amino acid other than arginine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARAXHAWQLTQGATVLGLFRVTPEIPAGLPSPRSE

SEQ ID NO: 196 - protein, 174 aa, Artificial sequence
  Synthetic polypeptide
  Misc_feature (144)..(144): any amino acid other than histidine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARXAWQLTQGATVLGLFRVTPEIPAGLPSPRSE

SEQ ID NO: 197 - protein, 174 aa, Artificial sequence
  Synthetic polypeptide
  Misc_feature (146)..(146): any amino acid other than tryptophan
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAXQLTQGATVLGLFRVTPEIPAGLPSPRSE

SEQ ID NO: 198 - protein, 174 aa, Artificial sequence
  Synthetic polypeptide
  Misc_feature (148)..(148): any amino acid other than leucine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQXTQGATVLGLFRVTPEIPAGLPSPRSE

SEQ ID NO: 199 - protein, 174 aa, Artificial sequence
  Synthetic polypeptide
  Misc_feature (149)..(149): any amino acid other than threonine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLXQGATVLGLFRVTPEIPAGLPSPRSE

SEQ ID NO: 200 - protein, 174 aa, Artificial sequence
  Synthetic polypeptide
  Misc_feature (150)..(150): any amino acid other than glutamine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTXGATVLGLFRVTPEIPAGLPSPRSE

SEQ ID NO: 201 - protein, 174 aa, Artificial sequence
  Synthetic polypeptide
  Misc_feature (151)..(151): any amino acid other than glycine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQXATVLGLFRVTPEIPAGLPSPRSE

SEQ ID NO: 202 - protein, 174 aa, Artificial sequence
  Synthetic polypeptide
  Misc_feature (153)..(153): any amino acid other than threonine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGAXVLGLFRVTPEIPAGLPSPRSE

SEQ ID NO: 203 - protein, 174 aa, Artificial sequence
  Synthetic polypeptide
  Misc_feature (154)..(154): any amino acid other than valine
PAGLLDLRQGMFAQLVAQNVLLIGGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATXLGLFRVTPEIPAGLPSPRSE

SEQ ID NO: 204 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 325 aa, Homo sapiens
STKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 206 - protein, 246 aa, Homo sapiens
HKPSNTKVDKRVELKTPLGDTTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 383 aa, Homo sapiens
PTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPRSTTFWAWSVLRVPAPPSPQPATYTCVVSHEDSRTLLNASRSLEVSYVTDHGPMK

SEQ ID NO: 208 - protein, 276 aa, Homo sapiens
VTSTLTIKZSDWLGESMFTCRVDHRGLTFQQNASSMCVPDQDTAIRVFAIPPSFASIFLTKSTKLTCLVTDLTTYBSVTISWTREENGAVKTHTNISESHPNATFSAVGEASICEDBDWSGERFTCTVTHTDLPSPLKQTISRPKGVALHRPBVYLLPPARZZLNLRESATITCLVTGFSPADVFVEWMQRGEPLSPQKYVTSAPMPEPQAPGRYFAHSILTVSEEEWNTGGTYTCVVAHEALPNRVTERTVDKSTGKPTLYNVSLVMSDTAGTCY

SEQ ID NO: 209 - protein, 353 aa, Homo sapiens
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 210 - protein, 222 aa, Homo sapiens
ADPCDSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 211 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 212 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 213 - protein, 227 aa, Artificial sequence
  Synthetic polypeptide
DKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 227 aa, Artificial sequence
  Synthetic polypeptide
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - protein, 227 aa, Artificial sequence
  Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 365 aa, Homo sapiens
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 217 - protein, 362 aa, Homo sapiens
MLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 218 - protein, 366 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 219 - protein, 5 aa, Artificial sequence
  synthetic sequence
GTLRG

SEQ ID NO: 220 - protein, 5 aa, Artificial sequence
  synthetic sequence
YNQSE

SEQ ID NO: 221 - protein, 5 aa, Artificial sequence
  synthetic sequence
TAADM

SEQ ID NO: 222 - protein, 5 aa, Artificial sequence
  synthetic sequence
AQTTK

SEQ ID NO: 223 - protein, 5 aa, Artificial sequence
  synthetic sequence
VETRP

SEQ ID NO: 224 - protein, 5 aa, Artificial sequence
  synthetic sequence
GDGTF

SEQ ID NO: 225 - protein, 276 aa, Artificial sequence
  synthetic sequence
GSHSMRYFFTSVSRPGRGEPRFIAVGYVDDTQFVRFDSDAASQRMEPRAPWIEQEGPEYWDGETRKVKAHSQTHRVDLGTLRGAYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEP

SEQ ID NO: 226 - protein, 276 aa, Artificial sequence
  synthetic sequence
GSHSMRYFFTSVSRPGRGEPRFIAVGYVDDTQFVRFDSDAASQRMEPRAPWIEQEGPEYWDGETRKVKAHSQTHRVDLGTLRGCYNQSEAGSHTVQRMYGCDVGSDWRFLRGYHQYAYDGKDYIALKEDLRSWTAADMCAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEP

SEQ ID NO: 227 - protein, 275 aa, Homo sapiens
GSHSMRYFYTSVSRPGRGEPRFIAVGYVDDTQFVRFDSDAASQRMEPRAPWIEQEGPEYWDQETRNVKAQSQTDRVDLGTLRGYYNQSEDGSHTIQIMYGCDVGPDGRFLRGYRQDAYDGKDYIALNEDLRSWTAADMAAQITKRKWEAAHAAEQQRAYLEGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWE

SEQ ID NO: 228 - protein, 275 aa, Artificial sequence
  synthetic sequence
GSHSMRYFYTSVSRPGRGEPRFIAVGYVDDTQFVRFDSDAASQRMEPRAPWIEQEGPEYWDQETRNVKAQSQTDRVDLGTLRGAYNQSEDGSHTIQIMYGCDVGPDGRFLRGYRQDAYDGKDYIALNEDLRSWTAADMAAQITKRKWEAAHAAEQQRAYLEGTCVEWLRRYLENGKETLQRTDPPKTHMTHHPISDHEATLRCWALGFYPAEITLTWQRDGEDQTQDTELVETRPCGDGTFQKWAAVVVPSGEEQRYTCHVQHEGLPKPLTLRWE

SEQ ID NO: 229 - protein, 276 aa, Homo sapiens [sequence omitted]

SEQ ID NO: 230 - protein, 276 aa, Artificial sequence
  synthetic sequence
GSHSMRYFYTSVSRPGRGEPRFISVGYVDDTQFVRFDSDAASPREEPRAPWIEQEGPEYWDRNTQIYKAQAQTDRESLRNLRGAYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPCGDRTFQKWAAVVVPSGEEQRYTCHVQHEGLPKPLTLRWEP

SEQ ID NO: 231 - protein, 276 aa, Artificial sequence
  synthetic sequence
GSHSMRYFYTSVSRPGRGEPRFISVGYVDDTQFVRFDSDAASPREEPRAPWIEQEGPEYWDRNTQIYKAQAQTDRESLRNLRGCYNQSEAGSHTLQSMYGCDVGPDGRLLRGHDQYAYDGKDYIALNEDLRSWTAADTCAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEP

SEQ ID NO: 232 - protein, 276 aa, Homo sapiens
CSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEP

SEQ ID NO: 233 - protein, 276 aa, Artificial sequence
  synthetic sequence
CSHSMRYFDTAVSRPGRGEPRFISVGYVDDTQFVRFDSDAASPRGEPRAPWVEQEGPEYWDRETQNYKRQAQADRVSLRNLRGAYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPCGDGTFQKWAAVVVPSGQEQRYTCHMQHEGLQEPLTLSWEP

SEQ ID NO: 234 - protein, 276 aa, Artificial sequence
  synthetic sequence
CSHSMRYFDTAVSRPGRGEPRFISVGYVDDTQFVRFDSDAASPRGEPRAPWVEQEGPEYWDRETQNYKRQAQADRVSLRNLRGCYNQSEDGSHTLQRMYGCDLGPDGRLLRGYDQSAYDGKDYIALNEDLRSWTAADTCAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEP

SEQ ID NO: 235 - protein, 5 aa, Artificial sequence
  synthetic sequence
GCGGS

SEQ ID NO: 236 - protein, 20 aa, Artificial sequence
  synthetic sequence
GCGGSGGGGSGGGGSGGGGS

SEQ ID NO: 237 - protein, 15 aa, Artificial sequence
  synthetic sequence
GCGGSGGGGSGGGGS

SEQ ID NO: 238 - protein, 10 aa, Artificial sequence
  synthetic sequence
FLPSDFFPSV

SEQ ID NO: 239 - protein, 10 aa, Artificial sequence
  synthetic sequence
GLSRYVARLG

SEQ ID NO: 240 - protein, 9 aa, Artificial sequence
  synthetic sequence
KLHLYSHPI

SEQ ID NO: 241 - protein, 9 aa, Artificial sequence
  synthetic sequence
FLLSLGIHL

SEQ ID NO: 242 - protein, 9 aa, Artificial sequence
  synthetic sequence
ALMPLYACI

SEQ ID NO: 243 - protein, 9 aa, Artificial sequence
  synthetic sequence
SLYADSPSV

SEQ ID NO: 244 - DNA, 1587 bp, Artificial sequence
  synthetic sequence
atgtacaggatgcaactcctgtcttgcattgcactaagtcttgcacttgtcacaaacagtggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggcgcctacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggccttgcggggatggaaccttccagaagtgggcggctgtggtggtgccttctggacaggagcagagatacacctgccatgtgcagcatgagggtttgcccaagcccctcaccctgagatgggaggcagctgcgggtggcgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcacgaggctctgcacaaccactacacgcagaagtccctctccctgtctccgggtaaatagtga

SEQ ID NO: 245 - protein, 507 aa, Artificial sequence
  synthetic sequence
GSHSMRYFFTSVSRPGRGEPRFIAVGYVDDTQFVRFDSDAASQRMEPRAPWIEQEGPEYWDGETRKVKAHSQTHRVDLGTLRGAYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEAAAGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - DNA, 1587 bp, Artificial sequence
  synthetic sequence
atgtatcgcatgcaactgctgagctgcattgcactctctctggcactcgtcaccaattccggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctgctacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggccttgcggggatggaaccttccagaagtgggcggctgtggtggtgccttctggacaggagcagagatacacctgccatgtgcagcatgagggtttgcccaagcccctcaccctgagatgggaggcagctgcgggtggcgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcacgaggctctgcacaaccactacacgcagaagtccctctccctgtctccgggtaaatagtga

SEQ ID NO: 247 - protein, 507 aa, Artificial sequence
  synthetic sequence
GSHSMRYFFTSVSRPGRGEPRFIAVGYVDDTQFVRFDSDAASQRMEPRAPWIEQEGPEYWDGETRKVKAHSQTHRVDLGTLRGCYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEAAAGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 248 - DNA, 438 bp, Artificial sequence
  synthetic sequence
atgtctcgctccgtggccttagctgtgctcgcgctactctctctttctggcctggaggccttcctgccctccgacttcttcccctccgtgggtggaggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 249 - protein, 124 aa, Artificial sequence
  synthetic sequence
FLPSDFFPSVGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 250 - DNA, 438 bp, Artificial sequence
  synthetic sequence
atgtctcgctccgtggccttagctgtgctcgcgctactctctctttctggcctggaggccttcctgccctccgacttcttcccctccgtgggttgcggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 251 - protein, 124 aa, Artificial sequence
  synthetic sequence
FLPSDFFPSVGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 252 - DNA, 2505 bp, Artificial sequence
  synthetic sequence
atgtatcgcatgcaactgctgagctgcattgcactctctctggcactcgtcaccaattccgcccctacttccagctccaccaagaagacgcagcttcagctggaagcactgctgctcgatctgcagatgatactgaatggcattaacaactacaaaaaccccaagctcactcgcatgctgaccgctaaattctacatgcccaagaaggctacggaactgaagcacctgcagtgccttgaggaggaactcaagccactcgaggaggtgctgaacctggcacagtcaaagaactttcacctgcggccaagagacctgatttcgaacatcaacgtgattgtgctggaattgaagggctcagaaactacgttcatgtgcgagtacgccgacgaaactgctactatcgtggagttcttgaaccgctggatcacgttctgccagagcattatttcaactcttaccggtggaggtggttctggaggtggtggatcaggaggaggtggctccgggggtggaggtagcgctcccacgtcatcctccactaaaaagacccagctgcaactcgaggcactgttgctggacctccagatgattctgaacggaatcaacaactataagaacccgaagctgactagaatgttgactgccaaattttatatgccaaagaaggcaactgagttgaagcatctgcaatgcctggaagaggagctgaagccactggaagaggtgcttaacctcgctcagtccaagaacttccatctgcgcccacgggaccttatctccaacattaacgtgatcgtgctggaactgaagggatccgaaaccacttttatgtgcgaatacgctgacgaaaccgccactatcgtcgagttcctgaacaggtggatcaccttctgccagtccattatctccaccctcaccggaggaggaggatccggtggtggaggctcgggtggaggaggctcaggaggaggcggaagcggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggcgcctacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggccttgcggggatggaaccttccagaagtgggcggctgtggtggtgccttctggacaggagcagagatacacctgccatgtgcagcatgagggtttgcccaagcccctcaccctgagatgggaggcagctgcgggtggcgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcacgaggctctgcacaaccactacacgcagaagtccctctccctgtctccgggtaaatagtga

SEQ ID NO: 253 - protein, 813 aa, Artificial sequence
  synthetic sequence
APTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSAPTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSGSHSMRYFFTSVSRPGRGEPRFIAVGYVDDTQFVRFDSDAASQRMEPRAPWIEQEGPEYWDGETRKVKAHSQTHRVDLGTLRGAYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEAAAGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - DNA, 2505 bp, Artificial sequence
  synthetic sequence
atgtatcgcatgcaactgctgagctgcattgcactctctctggcactcgtcaccaattccgcccctacttccagctccaccaagaagacgcagcttcagctggaagcactgctgctcgatctgcagatgatactgaatggcattaacaactacaaaaaccccaagctcactcgcatgctgaccgctaaattctacatgcccaagaaggctacggaactgaagcacctgcagtgccttgaggaggaactcaagccactcgaggaggtgctgaacctggcacagtcaaagaactttcacctgcggccaagagacctgatttcgaacatcaacgtgattgtgctggaattgaagggctcagaaactacgttcatgtgcgagtacgccgacgaaactgctactatcgtggagttcttgaaccgctggatcacgttctgccagagcattatttcaactcttaccggtggaggtggttctggaggtggtggatcaggaggaggtggctccgggggtggaggtagcgctcccacgtcatcctccactaaaaagacccagctgcaactcgaggcactgttgctggacctccagatgattctgaacggaatcaacaactataagaacccgaagctgactagaatgttgactgccaaattttatatgccaaagaaggcaactgagttgaagcatctgcaatgcctggaagaggagctgaagccactggaagaggtgcttaacctcgctcagtccaagaacttccatctgcgcccacgggaccttatctccaacattaacgtgatcgtgctggaactgaagggatccgaaaccacttttatgtgcgaatacgctgacgaaaccgccactatcgtcgagttcctgaacaggtggatcaccttctgccagtccattatctccaccctcaccggaggaggaggatccggtggtggaggctcgggtggaggaggctcaggaggaggcggaagcggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctgctacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggccttgcggggatggaaccttccagaagtgggcggctgtggtggtgccttctggacaggagcagagatacacctgccatgtgcagcatgagggtttgcccaagcccctcaccctgagatgggaggcagctgcgggtggcgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcacgaggctctgcacaaccactacacgcagaagtccctctccctgtctccgggtaaatagtga

SEQ ID NO: 255 - protein, 813 aa, Artificial sequence
  synthetic sequence
APTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSAPTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSGSHSMRYFFTSVSRPGRGEPRFIAVGYVDDTQFVRFDSDAASQRMEPRAPWIEQEGPEYWDGETRKVKAHSQTHRVDLGTLRGCYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEAAAGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - DNA, 2271 bp, Artificial sequence
  synthetic sequence
atgtatcgcatgcaactgctgagctgcattgcactctctctggcactcgtcaccaattccgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctggcctatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacggaggaggaggatccggtggtggaggctcgggtggaggaggctcaggaggaggcggaagcggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggcgcctacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggccttgcggggatggaaccttccagaagtgggcggctgtggtggtgccttctggacaggagcagagatacacctgccatgtgcagcatgagggtttgcccaagcccctcaccctgagatgggaggcagctgcgggtggcgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcacgaggctctgcacaaccactacacgcagaagtccctctccctgtctccgggtaaatagtga

SEQ ID NO: 257 - protein, 735 aa, Artificial sequence
  synthetic sequence
VIHVTKEVKEVATLSCGHNVSVEELAQTRIYWQKEKKMVLTMMSGDMNIWPEYKNRTIFDITNNLSIVILALRPSDEGTYECVVLAYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNGGGGSGGGGSGGGGSGGGGSGSHSMRYFFTSVSRPGRGEPRFIAVGYVDDTQFVRFDSDAASQRMEPRAPWIEQEGPEYWDGETRKVKAHSQTHRVDLGTLRGAYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEAAAGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - DNA, 2271 bp, Artificial sequence
  synthetic sequence
atgtatcgcatgcaactgctgagctgcattgcactctctctggcactcgtcaccaattccgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctggcctatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacggaggaggaggatccggtggtggaggctcgggtggaggaggctcaggaggaggcggaagcggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctgctacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggccttgcggggatggaaccttccagaagtgggcggctgtggtggtgccttctggacaggagcagagatacacctgccatgtgcagcatgagggtttgcccaagcccctcaccctgagatgggaggcagctgcgggtggcgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcacgaggctctgcacaaccactacacgcagaagtccctctccctgtctccgggtaaatagtga

SEQ ID NO: 259 - protein, 735 aa, Artificial sequence
  synthetic sequence
VIHVTKEVKEVATLSCGHNVSVEELAQTRIYWQKEKKMVLTMMSGDMNIWPEYKNRTIFDITNNLSIVILALRPSDEGTYECVVLAYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNGGGGSGGGGSGGGGSGGGGSGSHSMRYFFTSVSRPGRGEPRFIAVGYVDDTQFVRFDSDAASQRMEPRAPWIEQEGPEYWDGETRKVKAHSQTHRVDLGTLRGCYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWEAAAGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - DNA, 2169 bp, Artificial sequence
  synthetic sequence
atgtctcgctccgtggccttagctgtgctcgcgctactctctctttctggcctggaggccttcctgccctccgacttcttcccctccgtgggtggaggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgggtggcggggggtccggaggaggtggatccggcggagggggatctggcggaggcggatcaggaggtggcggctctgaccctgcaggcctgctggatctgcggcagggcatgttcgcacaactcgtggcccagaacgtgctgctgatcgatggaccgctgtcctggtactccgacccgggacttgccggagtgtcactgactggaggattgtcctacgccgaagatacgaaggagctcgtcgtggcgaaggccggagtgtactatgtgttcttccagctcgaactccggagagtcgtggccggggaaggctccggctccgtgtcacttgccctgcacctccagccacttcggtcggccgctggagccgccgcactggccctgaccgtcgacctccctcctgcgtcctccgaggctcgcaactcggccttcggattccaagggcgccttctgcacctgtccgcgggacagaggctgggggtgcatctgcatactgaagcgcgggcacggcatgcttggcagctgactcagggagcaactgtcctgggtctgttccgcgtgactccggaaatccccgccggtggaggtggctcaggaggcggcggcagcggtggaggagggagcggaggaggcggatccggtggaggcggaagcgaccctgccggactcctggatctgcggcagggcatgttcgcccagttggtggcgcagaacgtcctgctcattgacgggccgctgtcgtggtacagcgatccgggcttggccggagtctcgctgaccggaggactcagctacgccgaagataccaaggagctggtcgtggccaaggccggagtgtactacgtgttcttccaactggaactgcgccgggtggtggctggcgaaggatccgggtcggtgtccctggccctgcatctgcagcctctgcgctcagccgcaggagcagccgccttggcgctcaccgtggaccttccgcccgcctcctcggaagcccggaacagcgccttcggcttccaaggcagactcctgcacttgagcgcgggccagagactgggagtgcacctccacaccgaagcgcgcgcaaggcacgcctggcagctcacccagggagccaccgtgctgggcttgtttcgagtcacccccgagatcccagccggcggaggaggttccggtggcggtggatcaggcggtggaggctcgggtggagggggtagcggagggggtggttccgaccccgcaggactgctggacctccggcaggggatgttcgcgcaactggtggctcagaatgtcctgctgattgacggccccctgtcgtggtactcggaccctggccttgccggcgtgtccttgactggagggctgtcgtacgccgaggacactaaggagctggtcgtggccaaagccggcgtgtactacgtgttctttcagctggaactgaggagagtggtggcgggagaaggcagcggctcagtgtccctcgccctgcaccttcaaccactccgctctgccgctggtgcagctgcgctcgccctcactgtggatcttccaccggcaagctccgaggccagaaactccgccttcgggttccaggggaggctgctgcatctctccgccggccagagactgggcgtgcacttgcacactgaggctagggctcgccatgcctggcagctgacccagggcgccactgtgctgggactgttccgggtgaccccagaaatcccggcctcctagtga

SEQ ID NO: 261 - protein, 701 aa, Artificial sequence
  synthetic sequence
FLPSDFFPSVGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGGGGSGGGGSDPAGLLDLRQGMFAQLVAQNVLLIDGPLSWYSDPGLAGVSLTGGLSYAEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGGGGSGGGGSGGGGSGGGGSGGGGSDPAGLLDLRQGMFAQLVAQNVLLIDGPLSWYSDPGLAGVSLTGGLSYAEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGGGGSGGGGSGGGGSGGGGSGGGGSDPAGLLDLRQGMFAQLVAQNVLLIDGPLSWYSDPGLAGVSLTGGLSYAEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAS

SEQ ID NO: 262 - DNA, 2169 bp, Artificial sequence
  synthetic sequence
atgtctcgctccgtggccttagctgtgctcgcgctactctctctttctggcctggaggccttcctgccctccgacttcttcccctccgtgggttgcggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgggtggcggggggtccggaggaggtggatccggcggagggggatctggcggaggcggatcaggaggtggcggctctgaccctgcaggcctgctggatctgcggcagggcatgttcgcacaactcgtggcccagaacgtgctgctgatcgatggaccgctgtcctggtactccgacccgggacttgccggagtgtcactgactggaggattgtcctacgccgaagatacgaaggagctcgtcgtggcgaaggccggagtgtactatgtgttcttccagctcgaactccggagagtcgtggccggggaaggctccggctccgtgtcacttgccctgcacctccagccacttcggtcggccgctggagccgccgcactggccctgaccgtcgacctccctcctgcgtcctccgaggctcgcaactcggccttcggattccaagggcgccttctgcacctgtccgcgggacagaggctgggggtgcatctgcatactgaagcgcgggcacggcatgcttggcagctgactcagggagcaactgtcctgggtctgttccgcgtgactccggaaatccccgccggtggaggtggctcaggaggcggcggcagcggtggaggagggagcggaggaggcggatccggtggaggcggaagcgaccctgccggactcctggatctgcggcagggcatgttcgcccagttggtggcgcagaacgtcctgctcattgacgggccgctgtcgtggtacagcgatccgggcttggccggagtctcgctgaccggaggactcagctacgccgaagataccaaggagctggtcgtggccaaggccggagtgtactacgtgttcttccaactggaactgcgccgggtggtggctggcgaaggatccgggtcggtgtccctggccctgcatctgcagcctctgcgctcagccgcaggagcagccgccttggcgctcaccgtggaccttccgcccgcctcctcggaagcccggaacagcgccttcggcttccaaggcagactcctgcacttgagcgcgggccagagactgggagtgcacctccacaccgaagcgcgcgcaaggcacgcctggcagctcacccagggagccaccgtgctgggcttgtttcgagtcacccccgagatcccagccggcggaggaggttccggtggcggtggatcaggcggtggaggctcgggtggagggggtagcggagggggtggttccgaccccgcaggactgctggacctccggcaggggatgttcgcgcaactggtggctcagaatgtcctgctgattgacggccccctgtcgtggtactcggaccctggccttgccggcgtgtccttgactggagggctgtcgtacgccgaggacactaaggagctggtcgtggccaaagccggcgtgtactacgtgttctttcagctggaactgaggagagtggtggcgggagaaggcagcggctcagtgtccctcgccctgcaccttcaaccactccgctctgccgctggtgcagctgcgctcgccctcactgtggatcttccaccggcaagctccgaggccagaaactccgccttcgggttccaggggaggctgctgcatctctccgccggccagagactgggcgtgcacttgcacactgaggctagggctcgccatgcctggcagctgacccagggcgccactgtgctgggactgttccgggtgaccccagaaatcccggcctcctagtga

SEQ ID NO: 263 - protein, 701 aa, Artificial sequence
  synthetic sequence
FLPSDFFPSVGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGGGGSGGGGSDPAGLLDLRQGMFAQLVAQNVLLIDGPLSWYSDPGLAGVSLTGGLSYAEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGGGGSGGGGSGGGGSGGGGSGGGGSDPAGLLDLRQGMFAQLVAQNVLLIDGPLSWYSDPGLAGVSLTGGLSYAEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGGGGSGGGGSGGGGSGGGGSGGGGSDPAGLLDLRQGMFAQLVAQNVLLIDGPLSWYSDPGLAGVSLTGGLSYAEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAS

SEQ ID NO: 264 - DNA, 435 bp, Artificial sequence
  synthetic sequence
atgtctcgctccgtggccttagctgtgctcgcgctactctctctttctggcctggaggccaacctggtgccgatggtggcgaccgtggggggaggagcctcaggaggaggaggatccgggggtggaggtagcatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtgatag

SEQ ID NO: 265 - protein, 123 aa, Artificial sequence
  synthetic sequence
NLVPMVATVGGGASGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 266 - DNA, 435 bp, Artificial sequence
  synthetic sequence
atgtctcgctccgtggccttagctgtgctcgcgctactctctctttctggcctggaggccaacctggtgccgatggtggcgaccgtggggtgcggaggctcaggaggaggaggatccgggggtggaggtagcatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtgatag

SEQ ID NO: 267 - protein, 123 aa, Artificial sequence
  synthetic sequence
NLVPMVATVGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 268 - DNA, 435 bp, Artificial sequence
  synthetic sequence
atgtctcgctccgtggccttagctgtgctcgcgctactctctctttctggcctggaggccggcctgtcccggtacgtggcccggctgggtggaggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 269 - protein, 123 aa, Artificial sequence
  synthetic sequence
GLSRYVARLGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 270 - DNA, 435 bp, Artificial sequence
  synthetic sequence
atgtctcgctccgtggccttagctgtgctcgcgctactctctctttctggcctggaggccggcctgtcccggtacgtggcccggctgggttgcggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 271 - protein, 123 aa, Artificial sequence
  synthetic sequence
GLSRYVARLGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 272 - DNA, 435 bp, Artificial sequence
  synthetic sequence
atgtctcgctccgtggccttagctgtgctcgcgctactctctctttctggcctggaggccaagctgcacctgtactcccaccccatcggtggaggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 273 - protein, 123 aa, Artificial sequence
  synthetic sequence
KLHLYSHPIGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 274 - DNA, 435 bp, Artificial sequence
  synthetic sequence
atgtctcgctccgtggccttagctgtgctcgcgctactctctctttctggcctggaggccaagctgcacctgtactcccaccccatcggttgcggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 275 - protein, 123 aa, Artificial sequence
  synthetic sequence
KLHLYSHPIGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 276 - DNA, 435 bp, Artificial sequence
  synthetic sequence
atgtctcgctccgtggccttagctgtgctcgcgctactctctctttctggcctggaggccttcctgctgtccctgggcatccacctgggtggaggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 277 - protein, 123 aa, Artificial sequence
  synthetic sequence
FLLSLGIHLGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 278 - DNA, 435 bp, Artificial sequence
  synthetic sequence
atgtctcgctccgtggccttagctgtgctcgcgctactctctctttctggcctggaggccttcctgctgtccctgggcatccacctgggttgcggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 279 - protein, 123 aa, Artificial sequence
  synthetic sequence
FLLSLGIHLGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 280 - DNA, 435 bp, Artificial sequence
  synthetic sequence
atgtctcgctccgtggccttagctgtgctcgcgctactctctctttctggcctggaggccgccctgatgcccctgtacgcctgcatcggtggaggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 281 - protein, 123 aa, Artificial sequence
  synthetic sequence
ALMPLYACIGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 282 - DNA, 435 bp, Artificial sequence
  synthetic sequence
atgtctcgctccgtggccttagctgtgctcgcgctactctctctttctggcctggaggccgccctgatgcccctgtacgcctgcatcggttgcggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 283 - protein, 123 aa, Artificial sequence
  synthetic sequence
ALMPLYACIGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 284 - DNA, 435 bp, Artificial sequence
  synthetic sequence
atgtctcgctccgtggccttagctgtgctcgcgctactctctctttctggcctggaggcctccctgtacgccgactccccctccgtgggtggaggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 285 - protein, 123 aa, Artificial sequence
  synthetic sequence
SLYADSPSVGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 286 - DNA, 435 bp, Artificial sequence
  synthetic sequence
atgtctcgctccgtggccttagctgtgctcgcgctactctctctttctggcctggaggcctccctgtacgccgactccccctccgtgggttgcggtggttctggaggaggcggttcgggcggaggtggtagtatccagcgtactccaaagattcaggtttactcatgccatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtattatactgaattcacccccactgaaaaagatgagtatgcctgccgtgtgaaccacgtgactttgtcacagcccaagatagttaagtgggatcgagacatgtagtga

SEQ ID NO: 287 - protein, 123 aa, Artificial sequence
  synthetic sequence
SLYADSPSVGCGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 288 - protein, 275 aa, Homo sapiens
GSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWE

SEQ ID NO: 289 - protein, 275 aa, Homo sapiens
GSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWE

SEQ ID NO: 290 - protein, 275 aa, Homo sapiens
CSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWE

SEQ ID NO: 291 - protein, 275 aa, Artificial sequence
  synthetic sequence
GSHSMRYFFTSVSRPGRGEPRFIAVGYVDDTQFVRFDSDAASQRMEPRAPWIEQEGPEYWDGETRKVKAHSQTHRVDLGTLRGCYNQSEAGSHTVQRMYGCDVGSDWRFLRGYHQYAYDGKDYIALKEDLRSWTAADMCAQTTKHKWEAAHVAEQLRAYLEGTCVEWLRRYLENGKETLQRTDAPKTHMTHHAVSDHEATLRCWALSFYPAEITLTWQRDGEDQTQDTELVETRPCGDGTFQKWAAVVVPSGQEQRYTCHVQHEGLPKPLTLRWE

SEQ ID NO: 292 - protein, 254 aa, Artificial sequence
  synthetic sequence
GSHSMRYFFTSVSRPGRGEPRFIAVGYVDDTQFVRFDSDAASQRMEPRAPWIEQEGPEYWDGETRKVKAHSQTHRVDLAGSHTVQRMYGCDVGSDWRFLRGYHQYAYDGKDYIALKEDLRSWHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEP

SEQ ID NO: 293 - protein, 243 aa, Artificial sequence
  synthetic sequence
GSHSMRYFFTSVSRPGRGEPRFIAVGYVDDTQFVRFDSDAASQRMEPRAPWIEQEGPEYWDGETRKVKAHSQTHRVDLAGSHTVQRMYGCDVGSDWRFLRGYHQYAYDGKDYIALKEDLRSWHKWEAAHVAEQLRAYLEGTCVEWLRRYLENGKETLQRTDAPKTHMTHHAVSDHEATLRCWALSFYPAEITLTWQRDGEDQTQDTELQKWAAVVVPSGQEQRYTCHVQHEGLPKPLTLRWEP

SEQ ID NO: 294 - protein, 365 aa, Homo sapiens
MAVMAPRTLLLLLSGALALTQTWAGSHSMRYFYTSVSRPGRGEPRFIAVGYVDDTQFVRFDSDAASQRMEPRAPWIEQEGPEYWDQETRNVKAQSQTDRVDLGTLRGYYNQSEDGSHTIQIMYGCDVGPDGRFLRGYRQDAYDGKDYIALNEDLRSWTAADMAAQITKRKWEAAHAAEQQRAYLEGRCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 295 - protein, 365 aa, Homo sapiens [sequence omitted]

SEQ ID NO: 296 - protein, 365 aa, Homo sapiens [sequence omitted]

SEQ ID NO: 297 - protein, 5 aa, Artificial sequence
  synthetic polypeptide
RNLRG

SEQ ID NO: 298 - protein, 5 aa, Artificial sequence
  synthetic polypeptide
TAADT

SEQ ID NO: 299 - protein, 5 aa, Artificial sequence
  synthetic polypeptide
AQITQ

SEQ ID NO: 300 - protein, 5 aa, Artificial sequence
  synthetic polypeptide
GDRTF

SEQ ID NO: 301 - protein, 276 aa, Artificial sequence
  synthetic polypeptide
  Misc_feature (9)..(9): X is phenylalanine, tyrosine, serine, or threonine
  Misc_feature (44)..(44): X is lysine or arginine
  Misc_feature (62)..(62): X is glutamine, glycine, glutamic acid, or arginine
  Misc_feature (63)..(63): X is asparagine or glutamic acid
  Misc_feature (65)..(65): X is arginine or glycine
  Misc_feature (66)..(66): X is asparagine or lysine
  Misc_feature (67)..(67): X is methionine or valine
  Misc_feature (70)..(70): X is histidine or glutamine
  Misc_feature (73)..(73): X is threonine or isoleucine
  Misc_feature (74)..(74): X is aspartic acid or histidine
  Misc_feature (76)..(76): X is alanine, valine, or glutamic acid
  Misc_feature (77)..(77): X is asparagine or aspartic acid
  Misc_feature (79)..(79): X is glycine or arginine
  Misc_feature (80)..(80): X is threonine or arginine
  Misc_feature (81)..(81): X is leucine or alanine
  Misc_feature (82)..(82): X is arginine or leucine
  Misc_feature (83)..(83): X is glycine ir arginine
  Misc_feature (90)..(90): X is alanine or aspartic acid
  Misc_feature (95)..(95): X is isoleucine, leucine, or valine
  Misc_feature (97)..(97): X is isoleucine, arginine, or methionine
  Misc_feature (99)..(99): X is phenylalanine or tyrosine
  Misc_feature (105)..(105): X is serine or proline
  Misc_feature (107)..(107): X is tryptophan or glycine
  Misc_feature (114)..(114): X is arginine, histidine, or glutamine
  Misc_feature (116)..(116): X is aspartic acid or tyrosine
  Misc_feature (127)..(127): X is asparagine or lysine
  Misc_feature (142)..(142): X is threonine or isoleucine
  Misc_feature (144)..(144): X is lysine or glutamine
  Misc_feature (145)..(145): X is arginine or histidine
  Misc_feature (149)..(149): X is alanine or threonine
  Misc_feature (150)..(150): X is alanine or valine
  Misc_feature (151)..(151): X is histidine or arginine
  Misc_feature (156)..(156): X is arginine, leucine, glutamine, or tryptophan
  Misc_feature (158)..(158): X is valine or alanine
  Misc_feature (161)..(161): X is aspartic acid or glutamic acid
  Misc_feature (163)..(163): X is arginine or threonine
  Misc_feature (166)..(166): X is aspartic acid or glutamic acid
  Misc_feature (167)..(167): X is tryptophan or glycine
  Misc_feature (184)..(184): X is proline or alanine
  Misc_feature (193)..(193): X is proline or alanine
  Misc_feature (194)..(194): X is valine or isoleucine
  Misc_feature (207)..(207): X is serine or glycine
  Misc_feature (246)..(246): X is alanine or serine
  Misc_feature (253)..(253): X is glutamine or glutamic acid
  Misc_feature (276)..(276): X is proline or leucine
GSHSMRYFXTSVSRPGRGEPRFIAVGYVDDTQFVRFDSDAASQXMEPRAPWIEQEGPEYWDXXTXXXKAXSQXXRXXLXXXXXYYNQSEXGSHTXQXMXGCDVGXDXRFLRGYXQXAYDGKDYIALXEDLRSWTAADMAAQXTXXKWEXXXEAEQXRXYLXGXCVXXLRRYLENGKETLQRTDXPKTHMTHHXXSDHEATLRCWALXFYPAEITLTWQRDGEDQTQDTELVETRPAGDGTFQKWAXVVVPSGXEQRYTCHVQHEGLPKPLTLRWEX

SEQ ID NO: 302 - protein, 275 aa, Homo sapiens [sequence omitted]

SEQ ID NO: 303 - protein, 276 aa, Homo sapiens; identical to SEQ ID NO: 225

SEQ ID NO: 304 - protein, 275 aa, Homo sapiens; identical to SEQ ID NO: 58

SEQ ID NO: 305 - protein, 276 aa, Homo sapiens; identical to SEQ ID NO: 226

SEQ ID NO: 306 - protein, 341 aa, Homo sapiens
GSHSMRYFSTSVSRPGRGEPRFIAVGYVDDTQFVRFDSDAASQRMEPRAPWIEQEGPEYWDEETGKVKAHSQTDRENLRIALRYYNQSEAGSHTLQMMFGCDVGSDGRFLRGYHQYAYDGKDYIALKEDLRSWTAADMAAQITKRKWEAAHVAEQQRAYLEGTCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEPSSQPTVPIVGIIAGLVLLGAVITGAVVAAVMWRRNSSDRKGGSYSQAASSDSAQGSDVSLTACKV

SEQ ID NO: 307 - protein, 341 aa, Homo sapiens
GSHSMRYFTTSVSRPGRGEPRFIAVGYVDDTQFVRFDSDAASQRMEPRAPWIEQEGPEYWDRNTRNVKAHSQIDRVDLGTLRGYYNQSEAGSHTIQMMYGCDVGSDGRFLRGYQQDAYDGKDYIALNEDLRSWTAADMAAQITQRKWEAARVAEQLRAYLEGTCVEWLRRYLENGKETLQRTDPPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVFAGAVVAAVRWRRKSSDRKGGSYSQAASSDSAQGSDMSLTACKV

SEQ ID NO: 308 - protein, 276 aa, Artificial sequence
  synthetic polypeptide
  Misc_feature (9)..(9): X is histidinem tyrosine, or aspartic acid
  Misc_feature (11)..(11): X is alanien or serine
  Misc_feature (12)..(12): X is methionine or valine
  Misc_feature (24)..(24): X is alanine, serine, or threonine
  Misc_feature (32)..(32): X is glutamie or leucine
  Misc_feature (41)..(41): X is alanine or threonine
  Misc_feature (45)..(45): X is glutamic acid, methionine, lysine, or threonine
  Misc_feature (46)..(46): X is alanine or threonine
  Misc_feature (63)..(63): X is glutamic acid or asparagine
  Misc_feature (66)..(66): X is isoleucine or lysine
  Misc_feature (67)..(67): X is tyrosine, phenylalanie, serine, or cystine
  Misc_feature (70)..(70): X is asparagine or glutamine
  Misc_feature (71)..(71): X is alanine or threonine
  Misc_feature (74)..(74): X is aspartic acid or tyrosine
  Misc_feature (76)..(76): X is glutamic acid or valine
  Misc_feature (77)..(77): X is serine or asparagine
  Misc_feature (80)..(80): X is threonine, asparagine, or isoleucine
  Misc_feature (81)..(81): X is alanine or leucine
  Misc_feature (82)..(82): X is leucine or arginine
  Misc_feature (83)..(83): X is arginine or glycine
  Misc_feature (94)..(94): X is threonine or isoleucine
  Misc_feature (95)..(95): X is leucine or isoleucine
  Misc_feature (97)..(97): X is arginine or serine
  Misc_feature (131)..(131): X is arginine or serine
  Misc_feature (143)..(143): X is S or T
  Misc_feature (147)..(147): X is L or W
  misc_feature (152)..(152): Xaa is E OR V
  misc_feature (156)..(156): Xaa is R, D, L
  misc_feature (158)..(158): Xaa A or T
  Misc_feature (163)..(163): X is leucine, glutamic acid, or threonine
  Misc_feature (177)..(177): X is glutamic acid or aspartic acid
  Misc_feature (178)..(178): X is lysine or threonine
  Misc_feature (180)..(180): X is glutamic acid or glutamine
  Misc_feature (194)..(194): X is isoleucine or valine
GSHSMRYFXTXXSRPGRGEPRFIXVGYVDDTXFVRFDSDAXSPRXXPRAPWIEQEGPEYWDRXTQXXKTXXTQXYXXNLXXXXYYNQSEAGSHXXQXMYGCDLGPDGRLLRGHDQSAYDGKDYIALNEDLXSWTAADTAAQIXQRKXEAARXAEQXRXYLEGXCVEWLRRYLENGKXXLXRADPPKTHVTHHPXSDHEATLRCWALGFYPAEITLTWQRDGEDQTQDTELVETRPAGDRTFQKWAAVVVPSGEEQRYTCHVQHEGLPKPLTLRWEP

SEQ ID NO: 309 - protein, 362 aa, Homo sapiens; identical to SEQ ID NO: 217

SEQ ID NO: 310 - protein, 276 aa, Artificial sequence
  synthetic polypeptide
  Misc_feature (1)..(1): X is cysteine or glycine
  Misc_feature (6)..(6): X is arginine or lysine
  Misc_feature (9)..(9): X is phenylalanine, tyrosine, serine, or aspartic acid
  Misc_feature (14)..(14): X is arginine or tryptophan
  Misc_feature (21)..(21): X is histidine or arginine
  Misc_feature (24)..(24): X is alanine or serine
  Misc_feature (35)..(35): X is glutamine or arginine
  Misc_feature (49)..(49): X is alanine or arginine
  Misc_feature (66)..(66): X is asparagine, or lysine
  Misc_feature (73)..(73): X is threonine or alanine
  Misc_feature (77)..(77): X is serine or asparagine
  Misc_feature (80)..(80): X is asparagine or lysine
  Misc_feature (90)..(90): X is alanine or aspartic acid
  Misc_feature (91)..(91): X is glycine or arginine
  Misc_feature (94)..(94): X is threonine or isoleucine
  Misc_feature (95)..(95): X is leucine or isoleucine
  Misc_feature (97)..(97): X is tryptophan or arginine
  Misc_feature (99)..(99): X is cysteine, tyrosine, phenylalanine, or serine
  Misc_feature (103)..(103): X is leucine or valine
  Misc_feature (113)..(113): X is tyrosine or histidine
  Misc_feature (114)..(114): X is aspartic acid or asparagine
  Misc_feature (116)..(116): X is tyrosine, phenylalanine, serine, or leucine
  Misc_feature (147)..(147): X is leucine or tryptophan
  Misc_feature (152)..(152): X is glutamic acid, alanine, or threonine
  Misc_feature (156)..(156): X is arginine, leucine, or tryptophan
  Misc_feature (163)..(163): X is leucine or threonine
  Misc_feature (173)..(173): X is glutamic acid or lysine
  Misc_feature (177)..(177): X is glutamic acid or lysine
  Misc_feature (184)..(184): X is histidine or proline
  Misc_feature (194)..(194): X is arginine or valine
  Misc_feature (219)..(219): X is tryptophan or arginine
  Misc_feature (248)..(248): X is valine or methionine
  Misc_feature (253)..(253): X is glutamic acid or lysine
  Misc_feature (261)..(261): X is methionine or valine
  Misc_feature (267)..(267): X is proline or glutamine
  Misc_feature (273)..(273): X is arginine or serine
  Misc_feature (275)..(275): X is proline or glycine
XSHSMXYFXTAVSXPGRGEPXFIXVGYVDDTQFVXFDSDAASPRGEPRXPWVEQEGPEYWDRETQXYKRQAQXDRVXLRXLRGYYNQSEXXSHXXQXMXGCDXGPDGRLLRGXXQXAYDGKDYIALNEDLRSWTAADTAAQITQRKXEAARXAEQXRAYLEGXCVEWLRRYLXNGKXTLQRAEXPKTHVTHHPXSDHEATLRCWALGFYPAEITLTWQXDGEDQTQDTELVETRPAGDGTFQKWAAVXVPSGXEQRYTCHXQHEGLXEPLTLXWXP

SEQ ID NO: 311 - protein, 274 aa, Homo sapiens; identical to SEQ ID NO: 54

SEQ ID NO: 312 - protein, 223 aa, Homo sapiens
PPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPG

SEQ ID NO: 313 - protein, 252 aa, Artificial sequence
  synthetic polypeptide
  Misc_feature (79)..(79): An amino acid cluster independently selected from 1-5 naturally occuring amino acids, or any naturally occuring amino acid except proline or glycine
  Misc_feature (81)..(81): An amino acid cluster independently selected from 1-5 naturally occuring amino acids, or any naturally occuring amino acid except proline or glycine
  Misc_feature (126)..(126): An amino acid cluster independently selected from 1-5 naturally occuring amino acids, or any naturally occuring amino acid except proline or glycine
  Misc_feature (128)..(128): An amino acid cluster independently selected from 1-5 naturally occuring amino acids, or any naturally occuring amino acid except proline or glycine
  Misc_feature (215)..(215): An amino acid cluster independently selected from 1-5 naturally occuring amino acids, or any naturally occuring amino acid except proline or glycine
  Misc_feature (217)..(217): An amino acid cluster independently selected from 1-5 naturally occuring amino acids, or any naturally occuring amino acid except proline or glycine
GSHSMRYFFTSVSRPGRGEPRFIAVGYVDDTQFVRFDSDAASQRMEPRAPWIEQEGPEYWDGETRKVKAHSQTHRVDLXCXAGSHTVQRMYGCDVGSDWRFLRGYHQYAYDGKDYIALKEDLRSWXCXHKWEAAHVAEQLRAYLEGTCVEWLRRYLENGKETLQRTDAPKTHMTHHAVSDHEATLRCWALSFYPAEITLTWQRDGEDQTQDTELXCXQKWAAVVVPSGQEQRYTCHVQHEGLPKPLTLRWEP

SEQ ID NO: 314 - protein, 9 aa, Artificial sequence
  Synthetic sequence
STLPETTVV

SEQ ID NO: 315 - protein, 10 aa, Artificial sequence
  Synthetic sequence
LIMPARFYPK

SEQ ID NO: 316 - protein, 10 aa, Artificial sequence
  Synthetic sequence
AIMPARFYPK

SEQ ID NO: 317 - protein, 9 aa, Artificial sequence
  Synthetic sequence
YVNVNMGLK

SEQ ID NO: 318 - protein, 8 aa, Artificial sequence
  Synthetic sequence
PLGFFPDH

SEQ ID NO: 319 - protein, 15 aa, Artificial sequence
  Synthetic sequence
MQWNSTALHQALQDP

SEQ ID NO: 320 - protein, 9 aa, Artificial sequence
  Synthetic sequence
LLDPRVRGL

SEQ ID NO: 321 - protein, 10 aa, Artificial sequence
  Synthetic sequence
SILSKTGDPV

SEQ ID NO: 322 - protein, 9 aa, Artificial sequence
  Synthetic sequence
VLQAGFFLL

SEQ ID NO: 323 - protein, 9 aa, Artificial sequence
  Synthetic sequence
FLLTRILTI

SEQ ID NO: 324 - protein, 9 aa, Artificial sequence
  Synthetic sequence
FLGGTPVCL

SEQ ID NO: 325 - protein, 9 aa, Artificial sequence
  Synthetic sequence
LLCLIFLLV

SEQ ID NO: 326 - protein, 10 aa, Artificial sequence
  Synthetic sequence
LVLLDYQGML

SEQ ID NO: 327 - protein, 10 aa, Artificial sequence
  Synthetic sequence
LLDYQGMLPV

SEQ ID NO: 328 - protein, 9 aa, Artificial sequence
  Synthetic sequence
IPIPSSWAF

SEQ ID NO: 329 - protein, 9 aa, Artificial sequence
  Synthetic sequence
WLSLLVPFV

SEQ ID NO: 330 - protein, 10 aa, Artificial sequence
  Synthetic sequence
GLSPTVWLSV

SEQ ID NO: 331 - protein, 10 aa, Artificial sequence
  Synthetic sequence
SIVSPFIPLL

SEQ ID NO: 332 - protein, 9 aa, Artificial sequence
  Synthetic sequence
ILSPFLPLL

SEQ ID NO: 333 - protein, 17 aa, Artificial sequence
  Synthetic sequence
ATVELLSFLPSDFFPSV

SEQ ID NO: 334 - protein, 9 aa, Artificial sequence
  Synthetic sequence
LPSDFFPSV

SEQ ID NO: 335 - protein, 9 aa, Artificial sequence
  Synthetic sequence
CLTFGRETV

SEQ ID NO: 336 - protein, 10 aa, Artificial sequence
  Synthetic sequence
VLEYLVSFGV

SEQ ID NO: 337 - protein, 9 aa, Artificial sequence
  Synthetic sequence
EYLVSFGVW

SEQ ID NO: 338 - protein, 10 aa, Artificial sequence
  Synthetic sequence
ILSTLPETTV

SEQ ID NO: 339 - protein, 11 aa, Artificial sequence
  Synthetic sequence
STLPETTVVRR

SEQ ID NO: 340 - protein, 9 aa, Artificial sequence
  Synthetic sequence
NVSIPWTHK

SEQ ID NO: 341 - protein, 9 aa, Artificial sequence
  Synthetic sequence
KVGNFTGLY

SEQ ID NO: 342 - protein, 9 aa, Artificial sequence
  Synthetic sequence
GLYSSTVPV

SEQ ID NO: 343 - protein, 10 aa, Artificial sequence
  Synthetic sequence
TLWKAGILYK

SEQ ID NO: 344 - protein, 10 aa, Artificial sequence
  Synthetic sequence
TPARVTGGVF

SEQ ID NO: 345 - protein, 10 aa, Artificial sequence
  Synthetic sequence
LVVDFSQFSR

SEQ ID NO: 346 - protein, 9 aa, Artificial sequence
  Synthetic sequence
GLSRYVARL

SEQ ID NO: 347 - protein, 9 aa, Artificial sequence
  Synthetic sequence
SIACSVVRR

SEQ ID NO: 348 - protein, 9 aa, Artificial sequence
  Synthetic sequence
YMDDVVLGA

SEQ ID NO: 349 - protein, 10 aa, Artificial sequence
  Synthetic sequence
QAFTFSPTYK

SEQ ID NO: 350 - protein, 9 aa, Artificial sequence
  Synthetic sequence
KYTSFPWLL

SEQ ID NO: 351 - protein, 10 aa, Artificial sequence
  Synthetic sequence
ILRGTSFVYV

SEQ ID NO: 352 - protein, 9 aa, Artificial sequence
  Synthetic sequence
HLSLRGLFV

SEQ ID NO: 353 - protein, 9 aa, Artificial sequence
  Synthetic sequence
VLHKRTLGL

SEQ ID NO: 354 - protein, 10 aa, Artificial sequence
  Synthetic sequence
GLSAMSTTDL

SEQ ID NO: 355 - protein, 9 aa, Artificial sequence
  Synthetic sequence
CLFKDWEEL

SEQ ID NO: 356 - protein, 9 aa, Artificial sequence
  Synthetic sequence
VLGGCRHKL

SEQ ID NO: 357 - protein, 20 aa, Artificial sequence
  Synthetic sequence
MYRMQLLSCIALSLALVTNS

SEQ ID NO: 358 - protein, 20 aa, Artificial sequence
  Synthetic sequence
MSRSVALAVLALLSLSGLEA

SEQ ID NO: 359 - protein, 833 aa, Artificial sequence
  Synthetic sequence
MYRMQLLSCIALSLALVTNSAPTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSAPTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSGSHSMRYFYTSVSRPGRGEPRFIAVGYVDDTQFVRFDSDAASQRMEPRAPWIEQEGPEYWDQETRNVKAQSQTDRVDLGTLRGAYNQSEDGSHTIQIMYGCDVGPDGRFLRGYRQDAYDGKDYIALNEDLRSWTAADMAAQITKRKWEAAHAAEQQRAYLEGTCVEWLRRYLENGKETLQRTDPPKTHMTHHPISDHEATLRCWALGFYPAEITLTWQRDGEDQTQDTELVETRPCGDGTFQKWAAVVVPSGEEQRYTCHVQHEGLPKPLTLRWEAAAGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 858 aa, Artificial sequence
  Synthetic sequence
MYRMQLLSCIALSLALVTNSAPTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSAPTSSSTKKTQLQLEALLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSGSHSMRYFYTSVSRPGRGEPRFIAVGYVDDTQFVRFDSDAASQRMEPRAPWIEQEGPEYWDQETRNVKAQSQTDRVDLGTLRGAYNQSEDGSHTIQIMYGCDVGPDGRFLRGYRQDAYDGKDYIALNEDLRSWTAADMAAQITKRKWEAAHAAEQQRAYLEGTCVEWLRRYLENGKETLQRTDPPKTHMTHHPISDHEATLRCWALGFYPAEITLTWQRDGEDQTQDTELVETRPCGDGTFQKWAAVVVPSGEEQRYTCHVQHEGLPKPLTLRWEGGGGSGGGGSGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 144 aa, Artificial sequence
  Synthetic sequence
MSRSVALAVLALLSLSGLEALIMPARFYPKGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 362 - protein, 144 aa, Artificial sequence
  Synthetic sequence
MSRSVALAVLALLSLSGLEAAIMPARFYPKGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 363 - protein, 143 aa, Artificial sequence
  Synthetic sequence
MSRSVALAVLALLSLSGLEAYVNVNMGLKGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 364 - protein, 144 aa, Artificial sequence
  Synthetic sequence
MSRSVALAVLALLSLSGLEAFLPSDFFPSVGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 365 - protein, 143 aa, Artificial sequence
  Synthetic sequence
MSRSVALAVLALLSLSGLEASTLPETTVVGGGGSGGGGSGGGGSIQRTPKIQVYSCHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 366 - protein, 276 aa, Artificial sequence
  Synthetic sequence
GSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEL

SEQ ID NO: 367 - protein, 276 aa, Artificial sequence [sequence omitted]

SEQ ID NO: 368 - protein, 276 aa, Artificial sequence
  Synthetic sequence
GSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEL

SEQ ID NO: 369 - protein, 276 aa, Artificial sequence
  Synthetic sequence
GSHSMRYFYTSVSRPGRGEPRFIAVGYVDDTQFVRFDSDAASQRMEPRAPWIEQEGPEYWDQETRNVKAQSQTDRVDLGTLRGYYNQSEDGSHTIQIMYGCDVGPDGRFLRGYRQDAYDGKDYIALNEDLRSWTAADMAAQITKRKWEAAHAAEQQRAYLEGRCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEL

SEQ ID NO: 370 - protein, 276 aa, Artificial sequence
  Synthetic sequence
GSHSMRYFSTSVSRPGRGEPRFIAVGYVDDTQFVRFDSDAASQRMEPRAPWIEQEGPEYWDEETGKVKAHSQTDRENLRIALRYYNQSEAGSHTLQMMFGCDVGSDGRFLRGYHQYAYDGKDYIALKEDLRSWTAADMAAQITQRKWEAARVAEQLRAYLEGTCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEP

SEQ ID NO: 371 - protein, 276 aa, Artificial sequence
  Synthetic sequence
GSHSMRYFSTSVSRPGRGEPRFIAVGYVDDTQFVRFDSDAASQRMEPRAPWIEQEGPEYWDEETGKVKAHSQTDRENLRIALRYYNQSEAGSHTLQMMFGCDVGSDGRFLRGYHQYAYDGKDYIALKEDLRSWTAADMAAQITKRKWEAAHVAEQQRAYLEGTCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEP

SEQ ID NO: 372 - protein, 276 aa, Artificial sequence
  Synthetic sequence
GSHSMRYFSTSVSRPGRGEPRFIAVGYVDDTQFVRFDSDAASQRMEPRAPWIEQEGPEYWDEETGKVKAQSQTDRENLRIALRYYNQSEAGSHTLQMMFGCDVGSDGRFLRGYHQYAYDGKDYIALKEDLRSWTAADMAAQITKRKWEAAHVAEQQRAYLEGTCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEP

SEQ ID NO: 373 - protein, 276 aa, Artificial sequence
  Synthetic sequence
GSHSMRYFTTSVSRPGRGEPRFIAVGYVDDTQFVRFDSDAASQRMEPRAPWIEQEGPEYWDRNTRNVKAHSQIDRVDLGTLRGYYNQSEAGSHTIQMMYGCDVGSDGRFLRGYQQDAYDGKDYIALNEDLRSWTAADMAAQITQRKWEAARVAEQLRAYLEGTCVEWLRRYLENGKETLQRTDPPKTHMTHHAVSDHEATLRCWALSFYPAEITLTWQRDGEDQTQDTELVETRPAGDGTFQKWASVVVPSGQEQRYTCHVQHEGLPKPLTLRWEP

SEQ ID NO: 374 - protein, 276 aa, Artificial sequence
  Synthetic sequence
GSHSMRYFYTSVSRPGRGEPRFIAVGYVDDTQFVRFDSDAASQRMEPRAPWIEQEGPEYWDRNTRKVKAQSQTDRVDLGTLRGYYNQSEDGSHTIQRMYGCDVGPDGRFLRGYQQDAYDGKDYIALNEDLRSWTAADMAAQITQRKWETAHEAEQWRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEP

SEQ ID NO: 375 - protein, 276 aa, Artificial sequence [sequence omitted]

SEQ ID NO: 376 - protein, 276 aa, Artificial sequence
  Synthetic sequence
GSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEP

SEQ ID NO: 377 - protein, 276 aa, Artificial sequence
  Synthetic sequence
GSHSMRYFYTAMSRPGRGEPRFIAVGYVDDTQFVRFDSDAASPRMAPRAPWIEQEGPEYWDRNTQISKTNTQTYRESLRNLRGYYNQSEAGSHIIQRMYGCDVGPDGRLLRGYDQSAYDGKDYIALNEDLSSWTAADTAAQITQRKWEAAREAEQLRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEP

SEQ ID NO: 378 - protein, 276 aa, Artificial sequence
  Synthetic sequence
GSHSMRYFYTSVSRPGRGEPRFISVGYVDDTQFVRFDSDAASPREEPRAPWIEQEGPEYWDRNTQICKTNTQTYRENLRTALRYYNQSEAGSHTLQRMYGCDVGPDGRLLRGHNQFAYDGKDYIALNEDLSSWTAADTAAQITQRKWEAARVAEQLRTYLEGTCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEP

SEQ ID NO: 379 - protein, 276 aa, Artificial sequence
  Synthetic sequence
GSHSMRYFHTAMSRPGRGEPRFITVGYVDDTLFVRFDSDATSPRKEPRAPWIEQEGPEYWDRETQISKTNTQTYRESLRNLRGYYNQSEAGSHTLQRMYGCDVGPDGRLLRGHNQYAYDGKDYIALNEDLRSWTAADTAAQISQRKLEAARVAEQLRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEP

SEQ ID NO: 380 - protein, 276 aa, Artificial sequence
  Synthetic sequence
GSHSMRYFYTAMSRPGRGEPRFIAVGYVDDTQFVRFDSDAASPRMAPRAPWIEQEGPEYWDRETQKYKRQAQTDRVSLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEP

SEQ ID NO: 381 - protein, 276 aa, Artificial sequence
  Synthetic sequence
GSHSMRYFYTAMSRPGRGEPRFIAVGYVDDTQFVRFDSDAASPRTEPRAPWIEQEGPEYWDRNTQIFKTNTQTYRENLRIALRYYNQSEAGSHIIQRMYGCDLGPDGRLLRGHDQSAYDGKDYIALNEDLSSWTAADTAAQITQRKWEAARVAEQLRAYLEGLCVEWLRRYLENGKETLQRADPPKTHVTHHPVSDHEATLRCWALGFYPAEITLTWQRDGEDQTQDTELVETRPAGDRTFQKWAAVVVPSGEEQRYTCHVQHEGLPKPLTLRWEP

SEQ ID NO: 382 - protein, 276 aa, Artificial sequence
  Synthetic sequence
CSHSMKYFFTSVSRPGRGEPRFISVGYVDDTQFVRFDSDAASPRGEPRAPWVEQEGPEYWDRETQKYKRQAQTDRVSLRNLRGYYNQSEAGSHTLQWMCGCDLGPDGRLLRGYDQYAYDGKDYIALNEDLRSWTAADTAAQITQRKWEAAREAEQRRAYLEGTCVEWLRRYLENGKETLQRAEHPKTHVTHHPVSDHEATLRCWALGFYPAEITLTWQWDGEDQTQDTELVETRPAGDGTFQKWAAVMVPSGEEQRYTCHVQHEGLPEPLTLRWEP

SEQ ID NO: 383 - protein, 276 aa, Artificial sequence
  Synthetic sequence
GSHSMRYFYTAVSRPGRGEPHFIAVGYVDDTQFVRFDSDAASPRGEPRAPWVEQEGPEYWDRETQKYKRQAQTDRVSLRNLRGYYNQSEARSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEP

SEQ ID NO: 384 - protein, 276 aa, Artificial sequence
  Synthetic sequence
GSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEP

SEQ ID NO: 385 - protein, 276 aa, Artificial sequence
  Synthetic sequence
GSHSMRYFSTSVSWPGRGEPRFIAVGYVDDTQFVRFDSDAASPRGEPREPWVEQEGPEYWDRETQKYKRQAQADRVNLRKLRGYYNQSEDGSHTLQRMFGCDLGPDGRLLRGYNQFAYDGKDYIALNEDLRSWTAADTAAQITQRKWEAAREAEQRRAYLEGTCVEWLRRYLENGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWKP

SEQ ID NO: 386 - protein, 276 aa, Artificial sequence
  Synthetic sequence
CSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEP

SEQ ID NO: 387 - protein, 276 aa, Artificial sequence; identical to SEQ ID NO: 232
  Synthetic sequence

SEQ ID NO: 388 - protein, 276 aa, Artificial sequence
  Synthetic sequence
CSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEP

SEQ ID NO: 389 - protein, 276 aa, Artificial sequence
  Synthetic sequence
CSHSMRYFYTAVSRPGRGEPRFIAVGYVDDTQFVQFDSDAASPRGEPRAPWVEQEGPEYWDRETQKYKRQAQTDRVSLRNLRGYYNQSEAGSHTLQRMYGCDLGPDGRLLRGYNQFAYDGKDYIALNEDLRSWTAADTAAQITQRKWEAARTAEQLRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGP

SEQ ID NO: 390 - protein, 276 aa, Artificial sequence
  Synthetic sequence
CSHSMRYFYTAVSRPGRGEPHFIAVGYVDDTQFVRFDSDAASPRGEPRAPWVEQEGPEYWDRETQNYKRQAQTDRVNLRKLRGYYNQSEAGSHIIQRMYGCDLGPDGRLLRGHDQLAYDGKDYIALNEDLRSWTAADTAAQITQRKWEAAREAEQLRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEP

SEQ ID NO: 391 - protein, 275 aa, Homo sapiens; identical to SEQ ID NO: 288

SEQ ID NO: 392 - protein, 275 aa, Homo sapiens; identical to SEQ ID NO: 289

SEQ ID NO: 393 - protein, 275 aa, Homo sapiens; identical to SEQ ID NO: 290

SEQ ID NO: 394 - protein, 275 aa, Artificial sequence; identical to SEQ ID NO: 58
  Synthetic sequence

SEQ ID NO: 395 - protein, 275 aa, Artificial sequence; identical to SEQ ID NO: 291
  Synthetic sequence

SEQ ID NO: 396 - protein, 276 aa, Artificial sequence; identical to SEQ ID NO: 225
  Synthetic sequence

SEQ ID NO: 397 - protein, 284 aa, Artificial sequence
  Synthetic sequence
  misc_feature (89)..(89): Xaa is K or E
  misc_feature (107)..(107): Xaa is R or G
  misc_feature (157)..(157): Xaa is R or G
  misc_feature (158)..(158): Xaa is A or V
  misc_feature (255)..(255): Xaa is Q or P
  misc_feature (267)..(267): Xaa is P or S
GSHSLKYFHTSVSRPGRGEPRFISVGYVDDTQFVRFDNDAASPRMVPRAPWMEQEGSEYWDRETRSARDTAQIFRVNLRTLRGYYNQSXAGSHTLQWMHGCELGPDXRFLRGYEQFAYDGKDYLTLNEDLRSWTAVDTAAQISEQKSNDASEAEHQXXYLEDTCVEWLHKYLEKGKETLLHLEPPKTHVTHHPISDHEATLRCWALGFYPAEITLTWQQDGEGHTQDTELVETRPAGDGTFQKWAAVVVPSGEEXRYTCHVQHEGLXEPVTLRWKPASQPTIPI

SEQ ID NO: 398 - protein, 284 aa, Artificial sequence
  Synthetic sequence
  misc_feature (7)..(7): Xaa is Y or F
  misc_feature (50)..(50): Xaa is P or Q
  misc_feature (251)..(251): Xaa is S or P
  misc_feature (278)..(278): Xaa is P or L
GSHSLRXFSTAVSRPGRGEPRYIAVEYVDDTQFLRFDSDAAIPRMEPREXWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPXGEEQRYTCHVQHEGLPQPLILRWEQSXQPTIPI

SEQ ID NO: 399 - protein, 284 aa, Artificial sequence
  Synthetic sequence
  misc_feature (13)..(13): Xaa is S or F
  misc_feature (27)..(27): Xaa is Y or H
  misc_feature (31)..(31): Xaa is T, S, or M
  misc_feature (34)..(34): Xaa is L or V
  misc_feature (54)..(54): Xaa is Q or R
  misc_feature (81)..(81): Xaa is P or L
  misc_feature (100)..(100): Xaa is G or D
  misc_feature (104)..(104): Xaa is G or V
  misc_feature (105)..(105): Xaa is S or C
  misc_feature (110)..(110): Xaa is L or I
  misc_feature (159)..(159): Xaa is Y or H
  misc_feature (169)..(169): Xaa is H or R
  misc_feature (171)..(171): Xaa is Y or H
  misc_feature (178)..(178): Xaa is M or T
  misc_feature (185)..(185): Xaa is P or A
  misc_feature (219)..(219): Xaa is R, W, or Q
  misc_feature (258)..(258): Xaa is T or M
  misc_feature (275)..(275): Xaa is K or E
GSHSMRYFSAAVXRPGRGEPRFIAMGXVDDXQFXRFDSDSACPRMEPRAPWVEXEGPEYWEEETRNTKAHAQTDRMNLQTXRGYYNQSEASSHTLQWMIXCDLXXDGRLXRGYEQYAYDGKDYLALNEDLRSWTAADTAAQISKRKCEAANVAEQRRAXLEGTCVEWLXRXLENGKEXLQRADPXKTHVTHHPVFDYEATLRCWALGFYPAEIILTWQXDGEDQTQDVELVETRPAGDGTFQKWAAVVVPSGEEQRYXCHVQHEGLPEPLMLRWXQSSLPTIPI

SEQ ID NO: 400 - protein, 445 aa, Hepatitis B virus
MWLIITSRRDIIYTLFGRRVSYIKESPHVAPHFAGHHILGNKIYSMGGWSSKPRKGMGTNLSVPNPLGFFPDHQLDPAFKANSDNPDWDLNPHKDNWPDANKVGVGAFGPGFIPSHGGLLGWSPKAQGILTTVPAASLLASTIGKSGRQPTPLSPPLRDTHPQAMQWNSTTFHQTLQDPRVRALYFPAGGSSSGTVSPAQNTVSAISSILSKTGDPVPNMENIASGLLGPLLVLQAGFFLLTKILTIPQSLDSWWTSLNFLGGTPVCLGQNSQSQISSHSPTCCPPICPGYRWMCLRRFIIFLCILLLCLIFLLVLLDYQGMLPVCPLIPGSSTTSTGPCKTCTTPAQGTSMFTSCCCTKPTDGNCTCIPIPSSWAFAKYLWEWASVRFSWLSLLVPFVQWFVGLSPTVWLSVIWMMWYWGPSLYNILSPFMPLLPIFFCLWVYI

SEQ ID NO: 401 - protein, 281 aa, Hepatitis B virus
MQWNSSTFHQALLDPRVRGLYFPAGGSSSGTVNPVPTTASPISSIFSRTGDPAPNMESTTSGFLGPLLVLQAGFFLLTRILTIPQSLDSWWTSLNFLGGAPTCPGQNLQSPTSNHSQTSCPPICPGYRWMCLRRFIIFLFILLLCLIFLLVLLDYQGMLPVCPLLPGTSTTSTGPCKTCTTPAQGTSMFPSCCCTKPSDGNCTCIPIPSSWAFARFLWEWASVRFSWLSLLVPFVQWFVGLSPTVWLSVIWMMWYWGPSLYNILNPFLPLLPIFFCLWVYI

SEQ ID NO: 402 - protein, 226 aa, Hepatitis B virus
MESTTSGFLGPLLVLQAGFFLLTRILTIPQSLDSWWTSLNFLGGAPTCPGQNLQSPTSNHSQTSCPPICPGYRWMCLRRFIIFLFILLLCLIFLLVLLDYQGMLPVCPLLPGTSTTSTGPCKTCTTPAQGTSMFPSCCCTKPSDGNCTCIPIPSSWAFARFLWEWASVRFSWLSLLVPFVQWFVGLSPTVWLSVIWMMWYWGPSLYNILNPFLPLLPIFFCLWVYI

SEQ ID NO: 403 - protein, 843 aa, Hepatitis B virus
MPLSYQHFRKLLLLDEEAGPLEEELPRLADEGLNRRVAEDLNLGNLNVSIPWTHKVGNFTGLYSSTVPCFNPKWQTPSFPDIHLQEDIVDRCKQFVGPLTVNENRRLKLIMPARFYPNVTKYLPLDKGIKPYYPEHVVNHYFQTRHYLHTLWKAGILYKRESTRSASFCGSPYSWEQDLQHGRLVFKTSKRHGDKSFCPQSPGILPRSSVGPCIQSQLRKSRLGPQPAQGQLAGRQQGGSGSIRARVHPSPWGTVGVEPSGSGHTHNCASSSSSCLHQSAVRKAAYSLISTSKGHSSSGHAVELHHFPPNSSRSQSQGPVLSCWWLQFRNSEPCSEYCLCHIVNLIEDWGPCTEHGEHRIRTPRTPARVTGGVFLVDKNPHNTTESRLVVDFSQFSRGDTRVSWPKFAVPNLQSLTNLLSSNLSWLSLDVSAAFYHLPLHPAAMPHLLVGSSGLSRYVARLSSNSRIINNQHRTMQNLHNSCSRNLYVSLMLLYKTYGRKLHLYSHPIILGFRKIPMGVGLSPFLLAQFTSAICSVVRRAFPHCLAFSYMDDVVLGAKSVQHLESLYAAVTNFLLSLGIHLNPHKTKRWGYSLNFMGYVIGCWGTMPQEHIVQKIKMCFRKLPVNRPIDWKVCQRIVGLLGFAAPFTQCGYPALMPLYACIQAKQAFTFSPTYKAFLSKQYLNLYPVARQRSGLCQVFADATPTGWGLAIGHQRMRGTFVSPLPIHTAELLAACFARSRSGAKLIGTDNSVVLSRKYTSFPWLLGCAANWILRGTSFVYVPSALNPADDPSRGRLGLYRPLLRLLYRPTTGRTSLYADSPSVPSHLPDRVHFASPLHVAWRPP

SEQ ID NO: 404 - protein, 185 aa, Hepatitis B virus
MDIDPYKEFGASAELLSFLPSDFFPSVRDLLDTAKALFQEALESPEHCSPHHTALRQAILCWGDLMTLATWVGANLEDPASRDLVVNYVNTTAGLKFRQLLWFHISCLTFGRETVIEYLVSFGVWIRTPPPYRPPNAPILSTLPETTVVRYRDRGRSTRRRTPSPRRRRSQSPRRRRSQSRESQC

SEQ ID NO: 405 - protein, 212 aa, Hepatitis B virus
MQLFHLCLIISCSCPTVQASKLCLGWLWGMDIDPYKEFGASAELLSFLPSDFFPSIRDLLDTASALYREALESPEHCSPHHTALRQAILCWGELMNLATWVGSNLEDPASRELVVSYVNVNMGLKIRQLLWFHISCLTFGRETVLEYLVSFGVWIRTPPAYRPPNAPILSTLPETTVVRRRGRSPRRRTPSPRRRRSQSPRRRRSQSRGSQC

SEQ ID NO: 406 - protein, 154 aa, Hepatitis B virus
MAARLCCQLDPARDVLCLRPVGAESCGRPFSGSLGTLSSPSPSAVPTDHGAHLSLRGLPVCAFSSAGPCALRFTSARRMETTVNAHQILPKVLHKRTLGLSAMSTTDLEAYFKDCLFKDWEELGEEIRLKVFVLGGCRHKLVCAPAPCNFFTSA

What is claimed is:

1. A T-cell modulatory multimeric polypeptide (TMMP) comprising:
   at least one heterodimer comprising:
   a) a first polypeptide comprising:
      i) a hepatitis B virus (HBV) peptide epitope, wherein the HBV peptide has a length of at least 4 amino acids; and
      ii) first major histocompatibility complex (MHC) polypeptide;
   b) a second polypeptide comprising a second MHC polypeptide and an immunoglobulin (Ig) Fc polypeptide, and
   c) one or more immunomodulatory polypeptides that modulates a CD8+T cell that is specific for the HBV epitope,
   wherein the first and/or the second polypeptide comprises the immunomodulatory polypeptide, and
   wherein the first MHC polypeptide is β2-microglobulin (β2M) polypeptide; and wherein the second MHC polypeptide is an MHC class I heavy chain polypeptide,
   wherein at least one of the one or more immunomodulatory polypeptides is a variant immunomodulatory polypeptide that binds to a cognate co-immunomodulatory polypeptide and exhibits reduced affinity to the cognate co-immunomodulatory polypeptide compared to the affinity of a corresponding wild-type immunomodulatory polypeptide for the cognate co-immunomodulatory polypeptide.

2. A TMMP of claim 1, wherein the first or the second MHC polypeptide comprises an amino acid sequence having at least 95% amino acid sequence identity to the HLA-A*0101, HLA-A*0201, HLA-A*0301, HLA-A*1101, HLA-A*2301, HLA-A*2402, HLA-A*2407, HLA-A*3303, or HLA-A*3401 amino acid sequence set forth in SEQ ID NOs:366-374, wherein the percent sequence identity is determinable by a sequence alignment performed using BLAST.

3. A TMMP of claim 1, wherein
   a1) the first polypeptide comprises, in order from N-terminus to C-terminus:
      i) the HBV peptide epitope;
      ii) an optional linker; and
      iii) the β2M polypeptide, and
   b1) the second polypeptide comprises, in order from N-terminus to C-terminus:
      i) the one or more immunomodulatory polypeptides;
      ii) an optional linker;
      iii) the MHC class I heavy chain polypeptide;
      iv) an optional linker; and
      v) an Ig Fc polypeptide, or
   a2) the first polypeptide comprises, in order from N-terminus to C-terminus:
      i) the HBV peptide epitope;
      ii) an optional linker; and
      iii) the β2M polypeptide, and
   b2) the second polypeptide comprises, in order from N-terminus to C-terminus:
      i) the MHC class I heavy chain polypeptide;
      ii) an optional linker;
      iii) an Ig Fc polypeptide;
      iv) an optional linker; and
      v) the one or more immunomodulatory polypeptides,
   wherein when the second polypeptide comprises two or more immunomodulatory polypeptides, a linker may be interposed between each of the immunomodulatory polypeptides.

4. A TMMP of claim 3, comprising a disulfide bond between the first and second polypeptide.

5. A TMMP of claim 4, wherein the disulfide bond joins a Cys residue in the β2M polypeptide and a Cys residue in the MHC heavy chain polypeptide.

6. A TMMP of claim 5, wherein a Cys at amino acid residue 12 of the β2M polypeptide, based on the amino acid numbering of SEQ ID NO:56, is disulfide bonded to a Cys at amino acid residue 236 of the MHC heavy chain polypeptide, based on the amino acid numbering of SEQ ID NO:225.

7. A TMMP of claim 4, wherein the first polypeptide comprises a linker between the peptide epitope and the 02M polypeptide, wherein the linker comprises a Cys, and wherein a disulfide bond links the Cys present in the linker with a Cys of the MHC heavy chain polypeptide.

8. A TMMP of claim 4, wherein the at least one immunomodulatory polypeptide causes activation and/or proliferation of the CD8+T cell.

9. A TMMP of claim 8, wherein the at least one immunomodulatory polypeptide is selected from the group consisting of a wild type or variant polypeptide selected from the group consisting of IL-2, 4-1BBL, CD80, CD86, and combinations thereof.

10. A TMMP of claim 8, wherein the HBV peptide epitope comprises an amino acid sequence selected from the group consisting of FLPSDFFPSV, GLSRYVARLG, KLHLYSHPI, FLLSLGIHL, ALMPLYACI, SLYADSPSV, STLPETTVV, LIMPARFYPK, AIMPARFYPK, YVNVNMGLK, YVNVNMGLK, MQWNSTALHQALQDP, LLDPRVRGL, SILSKTGDPV, VLQAGFFLL, FLLTRILTI, FLGGTPVCL, LLCLIFLLV, LVLLDYQGML, LLDYQGMLPV, IPIPSSWAF, WLSLLVPFV, GLSPTVWLSV, SIVSPFIPLL, ILSPFLPLL, ATVELLSFLPSDFFPSV, LPSDFFPSV, CLTFGRETV, VLEYLVSFGV, EYLVSFGVW, ILSTLPETTV, STLPETTVVRR, NVSIPWTHK, KVGNFTGLY, GLYSSTVPV, TLWKAGILYK, TPARVTGGVF, LVVDFSQFSR, GLSRYVARL, SIACSVVRR, YMDDVVLGA, ALMPLYACI, ALMPLYACI, KYTSFPWLL, ILRGTSFVYV, HLSLRGLFV, VLHKRTLGL, GLSAMSTTDL, CLFKDWEEL, and VLGGCRHKL SEQ ID NOs: 238-243 and 314-356, respectively.

11. A TMMP of claim 8, wherein the HBV peptide epitope comprises an HBV epitope derived from HBV polymerase or HBV X-protein.

12. A TMMP of claim 9, comprising two immunomodulatory polypeptides in tandem, wherein the immunomodulatory polypeptides are IL-2 variant polypeptides comprising a substitution of H16 with Thr, Ala, Glu, or Asp relative to SEQ ID NO: 15, and wherein the two immunomodulatory polypeptides are joined by a linker.

13. A TMMP of claim 12 comprising two immunomodulatory polypeptides in tandem, wherein the immunomodulatory polypeptides are IL-2 variant polypeptides comprising a H16A substitution and further comprising a F42A substitution relative to SEQ ID NO:15, and wherein the two immunomodulatory polypeptides are joined by a linker.

14. A TMMP of claim 13, wherein the Ig Fc polypeptide is a variant of a human IgG1 Fc polypeptide, and wherein the variant comprises one or more mutations that reduce the ability of the IgG1 Fc polypeptide to induce cell lysis through activation of complement-dependent cytotoxicity, wherein the variant of a human IgG1 Fc polypeptide comprises a sequence having at least 95% sequence indentity to the amino acid sequence set forth in any one of SEQ ID NOs:213-215, wherein the percent sequence identity is determinable using BLAST, and wherein the variant IgG1 Fc polypeptide comprises: i) a Phe at position 14, a Glu at position 15 and a Ser at position 111 based on the numbering of SEQ ID NO: 213; ii) an Ala at position 77 based on the numbering of SEQ ID NO: 214; or iii) an Ala at position 14 and an Ala at position 15 based on the numbering of SEQ ID NO: 215.

15. A TMMP of claim 14 comprising two of the heterodimers, wherein the two heterodimers are disulfide linked to one another by one or more disulfide bonds between the IgG1 Fc polypeptides present in each of the heterodimers.

16. A pharmaceutical composition comprising a TMMP of claim 13.

17. A pharmaceutical composition comprising a TMMP of claim 14.

18. A pharmaceutical composition comprising a TMMP of claim 15.

* * * * *